(12) United States Patent
Dietrich et al.

(10) Patent No.: US 9,670,546 B2
(45) Date of Patent: Jun. 6, 2017

(54) METHODS AND NUCLEIC ACIDS FOR ANALYSES OF CELL PROLIFERATIVE DISORDERS

(75) Inventors: Dimo Dietrich, Berlin (DE); Ralf Lesche, Berlin (DE); Anne Fassbender, Berlin (DE); Manuel Krispin, Berlin (DE); Joern Dietrich, Berlin (DE)

(73) Assignee: EPIGENOMICS AG, Berlin (DE)

( * ) Notice: Subject to any disclaimer, the term of this patent is extended or adjusted under 35 U.S.C. 154(b) by 0 days.

(21) Appl. No.: 13/002,502

(22) PCT Filed: Jul. 15, 2009

(86) PCT No.: PCT/EP2009/059034
§ 371 (c)(1),
(2), (4) Date: Feb. 1, 2011

(87) PCT Pub. No.: WO2010/007083
PCT Pub. Date: Jan. 21, 2010

(65) Prior Publication Data
US 2011/0160091 A1    Jun. 30, 2011

(30) Foreign Application Priority Data
Jul. 15, 2008 (EP) .................................... 08160382

(51) Int. Cl.
C12P 21/00 (2006.01)
C12Q 1/68 (2006.01)

(52) U.S. Cl.
CPC ..... *C12Q 1/6886* (2013.01); *C12Q 2600/106* (2013.01); *C12Q 2600/112* (2013.01); *C12Q 2600/118* (2013.01); *C12Q 2600/136* (2013.01); *C12Q 2600/154* (2013.01); *C12Q 2600/156* (2013.01); *C12Q 2600/158* (2013.01)

(58) Field of Classification Search
None
See application file for complete search history.

(56) References Cited

U.S. PATENT DOCUMENTS

| 6,200,756 B1 | 3/2001 | Herman |
| 2005/0100933 A1 | 5/2005 | Erlander et al. |
| 2007/0264659 A1* | 11/2007 | An et al. ............................ 435/6 |
| 2007/0269823 A1* | 11/2007 | Huehn et al. ..................... 435/6 |

FOREIGN PATENT DOCUMENTS

| WO | WO 99/28498 A2 | 6/1999 |
| WO | WO 01/81622 A2 | 11/2001 |
| WO | WO 2005/100606 A2 | 10/2005 |
| WO | WO 2007/010258 A2 | 1/2007 |
| WO | WO 2007/085497 A2 | 8/2007 |

OTHER PUBLICATIONS

Ehrlich et al. (2002 Oncogene vol. 21 p. 5400-5413).*
Cottrell (Clinical Biochemistry 2004 vol. 37 p. 595-604).*
Walsh et al. (Genes & Development (1999) vol. 13, pp. 26-34).*
Booken et al., "Sézary Syndrome is a Unique Cutaneous T-Cell Lymphoma as Identified by an Expanded Gene Signature Including Diagnostic Marker Molecules CDO1 and DNM3," *Leukemia* (2008), 22:393-399, Nature Publishing Group.
Booken et al., "Sézary Syndrome is a Unique Cutaneous T-Cell Lymphoma as Identified by an Expanded Gene Signature Including Diagnostic Marker Molecules CDO1 and DNM3," *Leukemia* (2008), 22:393-399, Supplemental Data, Nature Publishing Group.
Hess et al., "Pharmacogenomic Predictor of Sensitivity to Preoperative Chemotherapy with Paclitaxel and Fluorouracil, Doxorubicin, and Cyclophosphamide in Breast Cancer," *J. Clin. Oncol.* (2006), 24(26):4236-4244, American Society of Clinical Oncology.
Li et al., "Integrated Gene Expression Profile Predicts Prognosis of Breast Cancer Patients," *Breast Cancer Res.* (2009), 113:231-237, Springer Science+Business Media, LLC.
Wang et al., "Comparison of the Time Courses of Selective Gene Expression and Dopaminergic Depletion Induced by MPP+ in MN9D Cells," *Neurochem. Int.* (2008) 52:1037-1043, Elsevier Ltd.
Jones P A: "The DNA methylation paradox", Trends in Genetics, Elsevier Science Publishers B.V. Amsterdam, NL, vol. 15, No. 1, Jan. 1, 1999 (Jan. 1, 1999), pp. 34-37, XP004155549.
European Office Action from application No. 09 780 607.9 (Jun. 14, 2013).
International Search Report with Written Opinion corresponding to International Patent Application No. PCT/EP2009/059034, mailed Jan. 7, 2010.

* cited by examiner

*Primary Examiner* — Celine Qian
(74) *Attorney, Agent, or Firm* — Lathrop & Gage, LLP; James H. Velema, Esq.; Sean M. Coughlin, Esq.

(57) ABSTRACT

The invention provides methods, nucleic acids and kits for determining the prognosis of a subject having cell proliferative disorder, preferably cancer. The invention discloses genomic sequences the methylation patterns of which have utility for the improved detection of said disorder, thereby enabling the improved diagnosis and treatment of patients.

5 Claims, 2 Drawing Sheets

METHODS AND NUCLEIC ACIDS FOR ANALYSES OF CELL PROLIFERATIVE DISORDERS

CROSS REFERENCE TO RELATED APPLICATIONS

This application is a 35 USC §371 National Stage application of International Application No. PCT/EP2009/059034 filed Jul. 15, 2009, now pending; which claims the benefit under 35 USC §119(a) to EP Patent Application No. 08160382.1 filed Jul. 15, 2008. The disclosure of each of the prior applications is considered part of and is incorporated by reference in the disclosure of this application.

FIELD OF THE INVENTION

The present invention relates to genomic DNA markers useful in determining the prognosis of a subject having cell proliferative disorder, preferably cancer. Particular embodiments provide methods, nucleic acids, nucleic acid arrays and kits useful for determining the prognosis of a subject having a cell proliferative disorder.

BACKGROUND

Anthracyclines are a large group of compounds synthesized by different *Streptomyces* species. They possess antibiotic activity and have cytotoxic effects on eukaryotic cells. All anthracyclines have a tetrahydronaphthacenedione ring structure attached by a glycosidic linkage to a sugar molecule, structural diversity of anthracyclines is generated by modifications of the backbone including a large number of different side chains.

Anthracyclines have excellent antineoplastic activity in metastatic, neoadjuvant, and adjuvant settings and are used in the treatment of various haematopoietic and solid tumours. Commonly used anthracyclines include but are not limited to mitoxantrone, doxorubicin, aclarubicin, daunorubicin, epirubicin and idarubicin. Although their mechanism of chemotherapeutic action is unclear involves noncovalent DNA intercalation, formation of covalent DNA adducts, topoisomerase II (topo II) poisoning, and free radical effects on cellular membranes and DNA. However, the clinical utility of anthracyclines are limited due to acute and chronic toxicities, particularly cardiotoxicity, myelosuppression, nausea and vomiting, and alopecia.

Heart failure following anthracycline therapy is a major clinical problem in cancer treatment. The establishment of predictors of the anthracycline treatment outcome would allow the identification and exclusion of individuals who would not benefit from said treatment, and thus to increase the safety of anthracycline treatment. Furthermore by determining which patients would benefit from Anthracycline treatment, but wherein said predicted outcome is suboptimal patients can be recommended for further chemotherapeutic or other treatments. Conversely by determining which patients would be adequately treated by anthracycline treatment alone the over-treatment of patients can be prevented.

SUMMARY OF THE INVENTION

The present invention provides a method for determining the prognosis of a subject having cell proliferative disorder, preferably cancer, in a subject comprising determining the expression levels of at least one gene selected from the group consisting of CDO1; APC; BMPR1A; CTAGE5; CXCL12; NCR1; NFATC2; PAX9; POU4F3; ZBTB16 in a biological sample isolated from said subject wherein methylation and/or expression status is indicative of the prognosis of said subject. Said method is particularly suited to determining prognosis of said subject subsequent to a therapy comprising at least one anthracycline. Various aspects of the present invention provide genetic markers, whereby expression analysis of said marker enables the determination of the prognosis of a subject having cell proliferative disorder, preferably cancer. The method according to the invention may be used for the analysis of a wide variety of cell proliferative disorders suitable for treatment with anthracyclines including, but not limited to, breast cancer, ovarian cancer, transitional cell bladder cancer, bronchogenic lung cancer, thyroid cancer, pancreatic cancer, prostate cancer, uterine cancer, testicular cancer, gastric cancer, soft tissue and osteogenic sarcomas, neuroblastoma, Wilms' tumor, malignant lymphoma (Hodgkin's and non-Hodgkin's), acute myeloblastic leukemia, acute lymphoblastic leukemia, Kaposi's sarcoma, Ewing's tumor, refractory multiple myeloma, squamous cell carcinomas of the head, neck, cervix, and vagina.

The method according to the invention may be used to provide a prediction of patient survival and/or relapse following treatment by means of a therapy comprising at least one anthracycline.

In one embodiment the invention provides a method for determining the prognosis of said subject comprising determining the expression levels of at least one gene selected from the group consisting of CDO1; APC; BMPR1A; CTAGE5; CXCL12; NCR1; NFATC2; PAX9; POU4F3; ZBTB16 in a biological sample isolated from said subject wherein under-expression and/or CpG methylation is indicative of the prognosis of said subject. In one embodiment said prognosis is the subject's prognosis subsequent to a therapy comprising at least one anthracycline. In one embodiment said expression level is determined by detecting the presence, absence or level of mRNA transcribed from said gene. In a further embodiment said expression level is determined by detecting the presence, absence or level of a polypeptide encoded by said gene or sequence thereof.

In a further preferred embodiment said expression is determined by detecting the presence, absence or amount of CpG methylation within said gene, and there from deducing the pronosis of said subject having cell proliferative disorder, preferably cancer.

Said method comprises the following steps: i) contacting genomic DNA isolated from a biological sample (preferably selected from the group consisting of cell lines, histological slides, paraffin embedded tissues, biopsies, tissue embedded in paraffin, bodily fluids (such as but not limited to nipple aspirate and blood) and all possible combinations thereof) obtained from the subject with at least one reagent, or series of reagents that distinguishes between methyllated and non-methylated CpG dinucleotides within at least one target region of the genomic DNA, wherein the nucleotide sequence of said target region comprises at least one CpG dinucleotide sequence of at least one gene selected from the group consisting of CDO1; APC; BMPR1A; CTAGE5; CXCL12; NCR1; NFATC2; PAX9; POU4F3; and ZBTB16 and ii) determining the prognosis of a subject having cell proliferative disorder, preferably cancer. Preferably the target region comprises, or hybridizes under stringent conditions to a sequence of at least 16 contiguous nucleotides of SEQ ID NO: 1-10, or preferred regions thereof according to SEQ ID NO: 11-20. In one embodiment said prognosis is the subject's prognosis subsequent to a therapy comprising at least one anthracycline.

Said use of the gene may be enabled by means of any analysis of the expression of the gene, by means of mRNA expression analysis or protein expression analysis. However, in the most preferred embodiment of the invention the determination of the prognosis of a subject having cell proliferative disorder, preferably cancer, is enabled by means of analysis of the methylation status of at least one gene selected from the group consisting of CDO1; APC; BMPR1A; CTAGE5; CXCL12; NCR1; NFATC2; PAX9; POU4F3; and ZBTB16, and/or promoter or regulatory elements thereof.

The invention provides a method for the analysis of biological samples for features associated with the progression of cell proliferative disorder, preferably cancer, the method characterized in that the nucleic acid, or a fragment thereof of SEQ ID NO: 1-10, or preferred regions thereof according to SEQ ID NO: 11-20 is contacted with a reagent or series of reagents capable of distinguishing between methylated and non methylated CpG dinucleotides within the genomic sequence.

The present invention provides a method for ascertaining epigenetic parameters of genomic DNA associated with the development of cell proliferative disorder, preferably cancer.

Preferably, the source of the test sample is selected from the group consisting of cell lines, histological slides, paraffin embedded tissues, biopsies, tissue embedded in paraffin, bodily fluids (such as but not limited to nipple aspirate and blood) and all possible combinations thereof and combinations thereof.

Specifically, the present invention provides a method for determining the prognosis of a subject having cell proliferative disorder, preferably cancer suitable for use as a prognostic and/or predictive tool, comprising: obtaining a biological sample comprising genomic nucleic acid(s); contacting the nucleic acid(s), or a fragment thereof, with a reagent or a plurality of reagents sufficient for distinguishing between methylated and non methylated CpG dinucleotide sequences within a target sequence of the subject nucleic acid, wherein the target sequence comprises, or hybridises under stringent conditions to, a sequence comprising at least 16 contiguous nucleotides of SEQ ID NO: 1-10, or preferred regions thereof according to SEQ ID NO: 11-20 said contiguous nucleotides comprising at least one CpG dinucleotide sequence; and determining, based at least in part on said distinguishing, the methylation state of at least one target CpG dinucleotide sequence, or an average, or a value reflecting an average methylation state of a plurality of target CpG dinucleotide sequences. In a preferred embodiment said prognosis is the subject's prognosis subsequent to a therapy comprising at least one anthracycline.

Preferably, distinguishing between methylated and non methylated CpG dinucleotide sequences within the target sequence comprises methylation state-dependent conversion or non-conversion of at least one such CpG dinucleotide sequence to the corresponding converted or non-converted dinucleotide sequence within a sequence selected from the group consisting of SEQ ID NO: 21-40 and 61-80 or preferred regions thereof according to SEQ ID NO: 41-60 and 81-100, and contiguous regions thereof corresponding to the target sequence.

Additional embodiments provide a method for the determination of the prognosis of a subject having cell proliferative disorder, preferably cancer comprising: obtaining a biological sample having subject genomic DNA; extracting the genomic DNA; treating the genomic DNA, or a fragment thereof, with one or more reagents to convert 5-position unmethylated cytosine bases to uracil or to another base that is detectably dissimilar to cytosine in terms of hybridization properties; contacting the treated genomic DNA, or the treated fragment thereof, with an amplification enzyme and at least two primers comprising, in each case a contiguous sequence at least 9 nucleotides in length that is complementary to, or hybridizes under moderately stringent or stringent conditions to a sequence selected from the group consisting SEQ ID NO: 21-40 and 61-80 or preferred regions thereof according to SEQ ID NO: 41-60 and 81-100, and complements thereof, wherein the treated DNA or the fragment thereof is either amplified to produce an amplificate, or is not amplified; and determining, based on a presence, absence or class of, or on a property of said amplificate, the methylation state or an average, or a value reflecting an average of the methylation level of at least one, but more preferably a plurality of CpG dinucleotides of SEQ ID NO: 1-10, or preferred regions thereof according to SEQ ID NO: 11-20.

Preferably, determining comprises use of at least one method selected from the group consisting of: i) hybridizing at least one nucleic acid molecule comprising a contiguous sequence at least 9 nucleotides in length that is complementary to, or hybridizes under moderately stringent or stringent conditions to a sequence selected from the group consisting of SEQ ID NO: 21-40 and 61-80 or preferred regions thereof according to SEQ ID NO: 41-60 and 81-100, and complements thereof; ii) hybridizing at least one nucleic acid molecule, bound to a solid phase, comprising a contiguous sequence at least 9 nucleotides in length that is complementary to, or hybridizes under moderately stringent or stringent conditions to a sequence selected from the group consisting of SEQ ID NO: 21-40 and 61-80 or preferred regions thereof according to SEQ ID NO: 41-60 and 81-100, and complements thereof; iii) hybridizing at least one nucleic acid molecule comprising a contiguous sequence at least 9 nucleotides in length that is complementary to, or hybridizes under moderately stringent or stringent conditions to a sequence selected from the group consisting of SEQ ID NO: 21-40 and 61-80 or preferred regions thereof according to SEQ ID NO: 41-60 and 81-100, and complements thereof, and extending at least one such hybridized nucleic acid molecule by at least one nucleotide base; and iv) sequencing of the amplificate.

Further embodiments provide a method for the analysis (i.e. determining disease progression and/or patient prognosis) of a cell proliferative disorder, preferably cancer, comprising: obtaining a biological sample having subject genomic DNA; extracting the genomic DNA; contacting the genomic DNA, or a fragment thereof, comprising one or more sequences selected from the group consisting of SEQ ID NO: 1-10, or preferred regions thereof according to SEQ ID NO: 11-20 or a sequence that hybridizes under stringent conditions thereto, with one or more methylation-sensitive restriction enzymes, wherein the genomic DNA is either digested thereby to produce digestion fragments, or is not digested thereby; and determining, based on a presence, absence or class of, or on property of at least one such fragment, the methyllation state of at least one CpG dinucleotide sequence of SEQ ID NO: 1-10, or preferred regions thereof according to SEQ ID NO: 11-20 or an average, or a value reflecting an average methylation state of a plurality of CpG dinucleotide sequences thereof. Preferably, the digested or undigested genomic DNA is amplified prior to said determining.

Additional embodiments provide novel genomic and chemically modified nucleic acid sequences, as well as oligonucleotides and/or PNA-oligomers for analysis of cytosine methylation patterns within SEQ ID NO: 1-10, or preferred regions thereof according to SEQ ID NO: 11-20.

DETAILED DESCRIPTION OF THE INVENTION

Definitions:

The term "prognosis" as used herein refers to a forecast of the course of a disease that is to be expected without the application of any treatment or intervention, whereas said course of disease includes the likelihood of progression of the disease, in particular its aggressiveness and metastatic potential in case the disease is a malignant tumor.

The term "prediction" as used herein refers to the likelihood of a patient suffering from a disease to respond to a treatment or an intervention directed against said disease. Thereby, said response is preferably defined according to patient survival. The term "prediction" is preferably used to define patients with high, low and intermediate length of survival or recurrence after treatment.

The term "Observed/Expected Ratio" ("O/E Ratio") refers to the frequency of CpG dinucleotides within a particular DNA sequence, and corresponds to the [number of CpG sites/(number of C bases×number of G bases)]/band length for each fragment.

The term "CpG island" refers to a contiguous region of genomic DNA that satisfies the criteria of (1) having a frequency of CpG dinucleotides corresponding to an "Observed/Expected Ratio">0.6, and (2) having a "GC Content">0.5. CpG islands are typically, but not always, between about 0.2 to about 1 KB, or to about 2 kb in length.

The term "methylation state" or "methylation status" refers to the presence, absence or class of 5-methylcytosine ("5-mCyt") at one or a plurality of CpG dinucleotides within a DNA sequence. Methylation states at one or more particular CpG methylation sites (each having two CpG dinucleotide sequences) within a DNA sequence include "unmethylated," "fullymethylated" and "hemi-methylated."

The term "hemi-methylation" or "hemimethylation" refers to the methylation state of a double stranded DNA wherein only one strand thereof is methylated.

The term 'AUC' as used herein is an abbreviation for the area under a curve. In particular it refers to the area under a Receiver Operating Characteristic (ROC) curve. The ROC curve is a plot of the true positive rate against the false positive rate for the different possible cut points of a diagnostic test. It shows the trade-off between sensitivity and specificity depending on the selected cut point (any increase in sensitivity will be accompanied by a decrease in specificity). The area under an ROC curve (AUC) is a measure for the accuracy of a test (the larger the area the better, optimum is 1, a random test would have a ROC curve lying on the diagonal with an area of 0.5; for reference: J. P. Egan. Signal Detection Theory and ROC Analysis, Academic Press, New York, 1975).

The term "microarray" refers broadly to both "DNA microarrays," and 'DNA chip(s),' as recognized in the art, encompasses all art-recognized solid supports, and encompasses all methods for affixing nucleic acid molecules thereto or synthesis of nucleic acids thereon.

"Genetic parameters" are mutations and polymorphisms of genes and sequences further required for their regulation. To be designated as mutations are, in particular, insertions, deletions, point mutations, inversions and polymorphisms and, particularly preferred, SNPs (single nucleotide polymorphisms).

"Epigenetic parameters" are, in particular, cytosine methylation. Further epigenetic parameters include, for example, the acetylation of histones which, however, cannot be directly analyzed using the described method but which, in turn, correlate with the DNA methylation.

The term "bisulfite reagent" refers to a reagent comprising bisulfite, disulfite, hydrogen sulfite or combinations thereof, useful as disclosed herein to distinguish between methylated and unmethylated CpG dinucleotide sequences.

The term "Methylation assay" refers to any assay for determining the methylation state of one or more CpG dinucleotide sequences within a sequence of DNA.

The term "MS.AP-PCR" (Methylation-Sensitive Arbitrarily-Primed Polymerase Chain Reaction) refers to the art-recognized technology that allows for a global scan of the genome using CG-rich primers to focus on the regions most likely to contain CpG dinucleotides, and described by Gonzalgo et al., *Cancer Research* 57:594-599, 1997.

The term "MethyLight™" refers to the art-recognized fluorescence-based real-time PCR technique described by Eads et al., *Cancer Res.* 59:2302-2306, 1999.

The term "HeavyMethyl™" assay, in the embodiment thereof implemented herein, refers to an assay, wherein methylation specific blocking probes (also referred to herein as blockers) covering CpG positions between, or covered by the amplification primers enable methylation-specific selective amplification of a nucleic acid sample.

The term "HeavyMethyl™ MethyLight™" assay, in the embodiment thereof implemented herein, refers to a HeavyMethyl™ MethyLight™ assay, which is a variation of the MethyLight™ assay, wherein the MethyLight™ assay is combined with methylation specific blocking probes covering CpG positions between the amplification primers.

The term "Ms-SNuPE" (Methylation-sensitive Single Nucleotide Primer Extension) refers to the art-recognized assay described by Gonzalgo and Jones, *Nucleic Acids Res.* 25:2529-2531, 1997.

The term "MSP" (Methylation-specific PCR) refers to the art-recognized methylation assay described by Herman et al. *Proc. Natl. Acad. Sci. USA* 93:9821-9826, 1996, and by U.S. Pat. No. 5,786,146.

The term "COBRA" (Combined Bisulfite Restriction Analysis) refers to the art-recognized methylation assay described by Xiong and Laird, *Nucleic Acids Res.* 25:2532-2534, 1997.

The term "MCA" (Methylated CpG Island Amplification) refers to the methylation assay described by Toyota et al., *Cancer Res.* 59:2307-12, 1999, and in WO 00/26401.

The term "hybridization" is to be understood as a bond of an oligonucleotide to a complementary sequence along the lines of the Watson-Crick base pairings in the sample DNA, forming a duplex structure.

"Stringent hybridization conditions," as defined herein, involve hybridizing at 68° C. in 5×SSC/5×Denhardt's solution/1.0% SDS, and washing in 0.2×SSC/0.1% SDS at room temperature, or involve the art-recognized equivalent thereof (e.g., conditions in which a hybridization is carried out at 60° C. in 2.5×SSC buffer, followed by several washing steps at 37° C. in a low buffer concentration, and remains stable). Moderately stringent conditions, as defined herein, involve including washing in 3×SSC at 42° C., or the art-recognized equivalent thereof. The parameters of salt concentration and temperature can be varied to achieve the optimal level of identity between the probe and the target nucleic acid. Guidance regarding such conditions is available in the art, for example, by Sambrook et al., 1989, Molecular Cloning, A Laboratory Manual, Cold Spring Harbor Press, N.Y.; and Ausubel et al. (eds.), 1995, Current Protocols in Molecular Biology, (John Wiley and Sons, N.Y.) at Unit 2.10.

The terms "Methylation-specific restriction enzymes" or "methylation-sensitive restriction enzymes" shall be taken to mean an enzyme that selectively digests a nucleic acid dependant on the methylation state of its recognition site. In the case of such restriction enzymes which specifically cut if the recognition site is not methylated or hemimethylated, the cut will not take place, or with a significantly reduced efficiency, if the recognition site is methylated. In the case of such restriction enzymes which specifically cut if the recognition site is methyllated, the cut will not take place, or with a significantly reduced efficiency if the recognition site is not methylated. Preferred are methylation-specific restriction enzymes, the recognition sequence of which contains a CG dinucleotide (for instance cgcg or cccggg). Further preferred for some embodiments are restriction enzymes that do not cut if the cytosine in this dinucleotide is methylated at the carbon atom C5.

"Non-methylation-specific restriction enzymes" or "non-methylation-sensitive restriction enzymes" are restriction enzymes that cut a nucleic acid sequence irrespective of the methylation state with nearly identical efficiency. They are also called "methylation-unspecific restriction enzymes."

In reference to composite array sequences, the phrase "contiguous nucleotides" refers to a contiguous sequence region of any individual contiguous sequence of the composite array, but does not include a region of the composite array sequence that includes a "node," as defined herein above.

The term "at least one gene selected from the group consisting of CDO1; APC; BMPR1A; CTAGE5; CXCL12; NCR1; NFATC2; PAX9; POU4F3; and ZBTB16" shall be taken to include all transcript variants thereof and all promoter and regulatory elements thereof. Furthermore as a plurality of SNPs are known within said gene the term shall be taken to include all sequence variants thereof.

Overview:

The present invention provides a method for determining the prognosis of a subject having cell proliferative disorder, preferably cancer comprising determining the methylation and/or expression levels of at least one gene selected from the group consisting of CDO1; APC; BMPR1A; CTAGE5; CXCL12; NCR1; NFATC2; PAX9; POU4F3; and ZBTB16 in a biological sample isolated from said subject wherein methylation and/or expression status is indicative of the prognosis of said subject having cell proliferative disorder, preferably cancer. In one embodiment said prognosis is the subject's prognosis subsequent to a therapy comprising at least one anthracycline.

In addition to the embodiments above wherein the methylation analysis of at least one gene selected from the group consisting of CDO1; APC; BMPR1A; CTAGE5; CXCL12; NCR1; NFATC2; PAX9; POU4F3; and ZBTB16 is analysed, the invention presents further panels of genes comprising at least one gene selected from the group consisting of CDO1; APC; BMPR1A; CTAGE5; CXCL12; NCR1; NFATC2; PAX9; POU4F3; and ZBTB16 with novel utility for the determination of the prognosis of a subject having cell proliferative disorder, preferably cancer.

Bisulfite modification of DNA is an art-recognized tool used to assess CpG methylation status. The most frequently used method for analyzing DNA for the presence of 5-methylcytosine is based upon the reaction of bisulfite with cytosine whereby, upon subsequent alkaline hydrolysis, cytosine is converted to uracil which corresponds to thymine in its base pairing behavior. Significantly, however, 5-methylcytosine remains unmodified under these conditions. Consequently, the original DNA is converted in such a manner that methylcytosine, which originally could not be distinguished from cytosine by its hybridization behavior, can now be detected as the only remaining cytosine using standard, art-recognized molecular biological techniques, for example, by amplification and hybridization, or by sequencing. All of these techniques are based on differential base pairing properties, which can now be fully exploited.

An overview of art-recognized methods for detecting 5-methylcytosine is provided by Rein, T., et al., *Nucleic Acids Res.*, 26:2255, 1998.

The bisulfite technique, barring few exceptions (e.g., Zeschnigk M, et al., *Eur J Hum Genet.* 5:94-98, 1997), is currently only used in research. In general, short, specific fragments of a known gene are amplified subsequent to a bisulfite treatment, and either completely sequenced (Olek and Walter, *Nat. Genet.* 1997 17:275-6, 1997), subjected to one or more primer extension reactions (Gonzalgo and Jones, Nucleic Acids Res., 25:2529-31, 1997; WO 95/00669; U.S. Pat. No. 6,251,594) to analyse individual cytosine positions, or treated by enzymatic digestion (Xiong and Laird, *Nucleic Acids Res.*, 25:2532-4, 1997). Detection by hybridisation has also been described in the art (Olek et al., WO 99/28498). Additionally, use of the bisulfite technique for methylation detection with respect to individual genes has been described (Grigg and Clark, *Bioessays,* 16:431-6, 1994; Zeschnigk M, et al., Hum Mol. Genet., 6:387-95, 1997; Feil R, et al., *Nucleic Acids Res.,* 22:695-, 1994; Martin V, et al., Gene, 157:261-4, 1995; WO 97/46705 and WO 95/15373).

The present invention provides for the use of the bisulfite technique, in combination with one or more methylation assays, for determination of the methylation status of CpG dinucleotide sequences within SEQ ID NO: 1-10, or preferred regions thereof according to SEQ ID NO: 11-20. Genomic CpG dinucleotides can be methylated or unmethylated (alternatively known as up- and down-methylated respectively). However the methods of the present invention are suitable for the analysis of biological samples of a heterogeneous nature e.g. a low concentration of tumor cells within a background of blood or ejaculate. Accordingly, when analyzing the methylation status of a CpG position within such a sample the person skilled in the art may use a quantitative assay for determining the level (e.g. percent, fraction, ratio, proportion or degree) of methylation at a particular CpG position as opposed to a methylation state. Accordingly the term methylation status or methylation state should also be taken to mean a value reflecting the degree of methylation at a CpG position. Unless specifically stated the terms "hypermethylated" or "upmethylated" shall be taken to mean a methylation level above that of a specified cut-off point, wherein said cut-off may be a value representing the average or median methylation level for a given population, or is preferably an optimized cut-off level. The "cut-off" is also referred herein as a "threshold". In the context of the present invention the terms "methylated", "hypermethylated" or "upmethylated" shall be taken to include a methylation level above the cut-off be zero (0) % (or equivalents thereof) methylation for all CpG positions within and associated with (e.g. in promoter or regulatory regions) at least one gene selected from the group consisting of CDO1; APC; BMPR1A; CTAGE5; CXCL12; NCR1; NFATC2; PAX9; POU4F3; and ZBTB16.

According to the present invention, determination of the methylation status of CpG dinucleotide sequences within SEQ ID NO: 1-10, or preferred regions thereof according to SEQ ID NO: 11-20 have utility in the determination of the prognosis of a subject having cell proliferative disorder, preferably cancer.

Methylation Assay Procedures. Various methylation assay procedures are known in the art, and can be used in conjunction with the present invention. These assays allow for determination of the methylation state of one or a plurality of CpG dinucleotides (e.g., CpG islands) within a DNA sequence. Such assays involve, among other techniques, DNA sequencing of bisulfite-treated DNA, PCR (for sequence-specific amplification), Southern blot analysis, and use of methylation-sensitive restriction enzymes.

For example, genomic sequencing has been simplified for analysis of DNA methylation patterns and 5-methylcytosine distribution by using bisulfite treatment (Frommer et al., *Proc. Natl. Acad. Sci. USA* 89:1827-1831, 1992). Additionally, restriction enzyme digestion of PCR products amplified from bisulfite-converted DNA is used, e.g., the method described by Sadri and Hornsby (*Nucl. Acids Res.* 24:5058-5059, 1996), or COBRA (Combined Bisulfite Restriction Analysis) (Xiong and Laird, *Nucleic Acids Res.* 25:2532-2534, 1997).

COBRA. COBRA™ analysis is a quantitative methylation assay useful for determining DNA methylation levels at specific gene loci in small amounts of genomic DNA (Xiong and Laird, *Nucleic Acids Res.* 25:2532-2534, 1997). Briefly, restriction enzyme digestion is used to reveal methylation-dependent sequence differences in PCR products of sodium bisulfite-treated DNA. Methylation-dependent sequence differences are first introduced into the genomic DNA by standard bisulfite treatment according to the procedure described by Frommer et al. (*Proc. Natl. Acad. Sci. USA* 89:1827-1831, 1992). PCR amplification of the bisulfite converted DNA is then performed using primers specific for the CpG islands of interest, followed by restriction endonuclease digestion, gel electrophoresis, and detection using specific, labeled hybridization probes. Methylation levels in the original DNA sample are represented by the relative amounts of digested and undigested PCR product in a linearly quantitative fashion across a wide spectrum of DNA methylation levels. In addition, this technique can be reliably applied to DNA obtained from micro-dissected paraffin-embedded tissue samples.

Typical reagents (e.g., as might be found in a typical COBRA™-based kit) for COBRA™ analysis may include, but are not limited to: PCR primers for specific gene (or bisulfite treated DNA sequence or CpG island); restriction enzyme and appropriate buffer; gene-hybridization oligonucleotide; control hybridization oligonucleotide; kinase labeling kit for oligonucleotide probe; and labeled nucleotides. Additionally, bisulfite conversion reagents may include: DNA denaturation buffer; sulfonation buffer; DNA recovery reagents or kits (e.g., precipitation, ultrafiltration, affinity column); desulfonation buffer; and DNA recovery components.

Preferably, assays such as "MethyLight™" (a fluorescence-based real-time PCR technique) (Eads et al., *Cancer Res.* 59:2302-2306, 1999), Ms-SNuPE™ (Methylation-sensitive Single Nucleotide Primer Extension) reactions (Gonzalgo and Jones, *Nucleic Acids Res.* 25:2529-2531, 1997), methylation-specific PCR ("MSP"; Herman et al., *Proc. Natl. Acad. Sci. USA* 93:9821-9826, 1996; U.S. Pat. No. 5,786,146), and methylated CpG island amplification ("MCA"; Toyota et al., *Cancer Res.* 59:2307-12, 1999) are used alone or in combination with other of these methods.

The "HeavyMethyl™" assay, technique is a quantitative method for assessing methylation differences based on methylation specific amplification of bisulfite treated DNA. Methylation specific blocking probes (also referred to herein as blockers) covering CpG positions between, or covered by the amplification primers enable methylation-specific selective amplification of a nucleic acid sample.

The term "HeavyMethyl™ MethyLight™" assay, in the embodiment thereof implemented herein, refers to a HeavyMethyl™ MethyLight™ assay, which is a variation of the MethyLight™ assay, wherein the MethyLight™ assay is combined with methylation specific blocking probes covering CpG positions between the amplification primers. The HeavyMethyl™ assay may also be used in combination with methylation specific amplification primers.

Typical reagents (e.g., as might be found in a typical MethyLight™-based kit) for HeavyMethyl™ analysis may include, but are not limited to: PCR primers for specific genes (or bisulfite treated DNA sequence or CpG island); blocking oligonucleotides; optimized PCR buffers and deoxynucleotides; and Taq polymerase.

MSP. MSP (methylation-specific PCR) allows for assessing the methylation status of virtually any group of CpG sites within a CpG island, independent of the use of methylation-sensitive restriction enzymes (Herman et al. *Proc. Natl. Acad. Sci. USA* 93:9821-9826, 1996; U.S. Pat. No. 5,786,146). Briefly, DNA is modified by sodium bisulfite converting all unmethylated, but not methylated cytosines to uracil, and subsequently amplified with primers specific for methylated versus unmethylated DNA. MSP requires only small quantities of DNA, is sensitive to 0.1% methylated alleles of a given CpG island locus, and can be performed on DNA extracted from paraffin-embedded samples. Typical reagents (e.g., as might be found in a typical MSP-based kit) for MSP analysis may include, but are not limited to: methylated and unmethylated PCR primers for specific gene (or bisulfite treated DNA sequence or CpG island), optimized PCR buffers and deoxynucleotides, and specific probes.

MethyLight™. The MethyLight™ assay is a high-throughput quantitative methylation assay that utilizes fluorescence-based real-time PCR (TaqMan™) technology that requires no further manipulations after the PCR step (Eads et al., *Cancer Res.* 59:2302-2306, 1999). Briefly, the MethyLight™ process begins with a mixed sample of genomic DNA that is converted, in a sodium bisulfite reaction, to a mixed pool of methylation-dependent sequence differences according to standard procedures (the bisulfite process converts unmethylated cytosine residues to uracil). Fluorescence-based PCR is then performed in a "biased" (with PCR primers that overlap known CpG dinucleotides) reaction. Sequence discrimination can occur both at the level of the amplification process and at the level of the fluorescence detection process.

The MethyLight™ assay may be used as a quantitative test for methylation patterns in the genomic DNA sample, wherein sequence discrimination occurs at the level of probe hybridization. In this quantitative version, the PCR reaction provides for a methylation specific amplification in the presence of a fluorescent probe that overlaps a particular putative methylation site. An unbiased control for the amount of input DNA is provided by a reaction in which neither the primers, nor the probe overlie any CpG dinucleotides. Alternatively, a qualitative test for genomic methylation is achieved by probing of the biased PCR pool with either control oligonucleotides that do not "cover" known methylation sites (a fluorescence-based version of the HeavyMethyl™ and MSP techniques), or with oligonucleotides covering potential methylation sites.

The MethyLight™ process can by used with any suitable probes e.g. "TagMan®", Lightcycler® and the likes. For example, double-stranded genomic DNA is treated with sodium bisulfite and subjected to one of two sets of PCR reactions using TaqMan® probes; e.g., with MSP primers and/or HeavyMethyl blocker oligonucleotides and TaqMan® probe. The TaqMan® probe is dual-labeled with fluorescent "reporter" and "quencher" molecules, and is designed to be specific for a relatively high GC content region so that it melts out at about 10° C. higher temperature in the PCR cycle than the forward or reverse primers. This allows the TaqMan® probe to remain fully hybridized during the PCR annealing/extension step. As the Taq polymerase enzymatically synthesizes a new strand during PCR, it will eventually reach the annealed TaqMan® probe. The Taq polymerase 5' to 3' endonuclease activity will then displace the TagMan® probe by digesting it to release the fluorescent reporter molecule for quantitative detection of its now unquenched signal using a real-time fluorescent detection system.

Typical reagents (e.g., as might be found in a typical MethyLight™-based kit) for MethyLight™ analysis may include, but are not limited to: PCR primers for specific gene (or bisulfite treated DNA sequence or CpG island); TaqMan® or Lightcycler® probes; optimized PCR buffers and deoxynucleotides; and Taq polymerase.

The QM™ (quantitative methylation) assay is an alternative quantitative test for methylation patterns in genomic DNA samples, wherein sequence discrimination occurs at the level of probe hybridization. In this quantitative version, the PCR reaction provides for unbiased amplification in the presence of a fluorescent probe that overlaps a particular putative methylation site. An unbiased control for the amount of input DNA is provided by a reaction in which neither the primers, nor the probe overlie any CpG dinucleotides. Alternatively, a qualitative test for genomic methylation is achieved by probing of the biased PCR pool with either control oligonucleotides that do not "cover" known methylation sites (a fluorescence-based version of the HeavyMethyl™ and MSP techniques), or with oligonucleotides covering potential methylation sites.

The QM™ process can by used with any suitable probes e.g. "TaqMan®", Lightcycler® etc. . . . in the amplification process. For example, double-stranded genomic DNA is treated with sodium bisulfite and subjected to unbiased primers and the TaqMan® probe. The TaqMan® probe is dual-labeled with fluorescent "reporter" and "quencher" molecules, and is designed to be specific for a relatively high GC content region so that it melts out at about 10° C. higher temperature in the PCR cycle than the forward or reverse primers. This allows the TaqMan® probe to remain fully hybridized during the PCR annealing/extension step. As the Taq polymerase enzymatically synthesizes a new strand during PCR, it will eventually reach the annealed Taq Man® probe. The Taq polymerase 5' to 3' endonuclease activity will then displace the TaqMan® probe by digesting it to release the fluorescent reporter molecule for quantitative detection of its now unquenched signal using a real-time fluorescent detection system. Typical reagents (e.g., as might be found in a typical QM™-based kit) for QM™ analysis may include, but are not limited to: PCR primers for specific gene (or bisulfite treated DNA sequence or CpG island); TaqMan® or Lightcycler® probes; optimized PCR buffers and deoxynucleotides; and Taq polymerase.

Ms-SNuPE. The Ms-SNuPE™ technique is a quantitative method for assessing methylation differences at specific CpG sites based on bisulfite treatment of DNA, followed by singlenucleotide primer extension (Gonzalgo and Jones, *Nucleic Acids Res.* 25:2529-2531, 1997). Briefly, genomic DNA is reacted with sodium bisulfite to convert unmethylated cytosine to uracil while leaving 5-methylcytosine unchanged. Amplification of the desired target sequence is then performed using PCR primers specific for bisulfite-converted DNA, and the resulting product is isolated and used as a template for methylation analysis at the CpG site(s) of interest. Small amounts of DNA can be analyzed (e.g., micro-dissected pathology sections), and it avoids utilization of restriction enzymes for determining the methylation status at CpG sites.

Typical reagents (e.g., as might be found in a typical Ms-SNuPE™-based kit) for MsSNuPE™ analysis may include, but are not limited to: PCR primers for specific gene (or bisulfite treated DNA sequence or CpG island); optimized PCR buffers and deoxynucleotides; gel extraction kit; positive control primers; Ms-SNuPE™ primers for specific gene; reaction buffer (for the Ms-SNuPE reaction); and labeled nucleotides. Additionally, bisulfite conversion reagents may include: DNA denaturation buffer; sulfonation buffer; DNA recovery regents or kit (e.g., precipitation, ultrafiltration, affinity column); desulfonation buffer; and DNA recovery components.

The genomic sequence(s) according to SEQ ID NO: 1-10 or preferred regions thereof according to SEQ ID NO: 11-20, and non-naturally occurring treated variants thereof according to SEQ ID NO: 21-40 and 61-80 or preferred regions thereof according to SEQ ID NO: 41-60 and 81-100, were determined to have novel utility for the determination of the prognosis of a subject having cell proliferative disorder, preferably cancer.

In one embodiment the method of the invention comprises the following steps: i) determining the methylation and/or expression of at least one gene selected from the group consisting of CDO1; APC; BMPR1A; CTAGE5; CXCL12; NCR1; NFATC2; PAX9; POU4F3; and ZBTB16 and ii) determining the prognosis of a subject having cell proliferative disorder, preferably cancer. In a preferred embodiment said prognosis is the subject's prognosis subsequent to a therapy comprising at least one anthracycline.

The method of the invention may be enabled by means of any analysis of the expression of an RNA transcribed therefrom or polypeptide or protein translated from said RNA, preferably by means of mRNA expression analysis or polypeptide expression analysis. However, in the most preferred embodiment of the invention the determination of the prognosis of a subject having cell proliferative disorder, preferably cancer, is enabled by means of analysis of the methylation status of at least one gene selected from the group consisting of CDO1; APC; BMPR1A; CTAGE5; CXCL12; NCR1; NFATC2; PAX9; POU4F3; and ZBTB16, and/or promoter or regulatory elements thereof.

Accordingly the present invention also provides prognostic and/or predictive assays and methods, both quantitative and qualitative for detecting the expression of at least one gene selected from the group consisting of CDO1; APC; BMPR1A; CTAGE5; CXCL12; NCR1; NFATC2; PAX9; POU4F3; and ZBTB16 in a subject and determining therefrom the prognosis of a subject having cell proliferative disorder, preferably cancer in said subject.

Aberrant expression of mRNA transcribed from at least one gene selected from the group consisting of CDO1; APC; BMPR1A; CTAGE5; CXCL12; NCR1; NFATC2; PAX9; POU4F3; and ZBTB16 is associated with the progression of cell proliferative disorder, preferably cancer in a subject.

To detect the presence of mRNA encoding a gene or genomic sequence, a sample is obtained from the subject. The sample may be any suitable sample comprising cellular matter of the tumor. Suitable sample types include cell lines, histological slides, paraffin embedded tissues, biopsies, tissue embedded in paraffin, bodily fluids (such as but not limited to nipple aspirate and blood) and all possible combinations thereof and all possible combinations thereof. It is preferred that said sample types are cell lines, histological slides, paraffin embedded tissues, biopsies, tissue embedded in paraffin, bodily fluids (such as but not limited to nipple aspirate and blood) and all possible combinations thereof.

The sample may be treated to extract the RNA contained therein. The resulting nucleic acid from the sample is then analyzed. Many techniques are known in the state of the art for determining absolute and relative levels of gene expression, commonly used techniques suitable for use in the present invention include in situ hybridisation (e.g. FISH), Northern analysis, RNase protection assays (RPA), microarrays and PCR-based techniques, such as quantitative PCR and differential display PCR or any other nucleic acid detection method.

Particularly preferred is the use of the reverse transcription/polymerization chain reaction technique (RT-PCR). The method of RT-PCR is well known in the art (for example, see Watson and Fleming, supra).

The RT-PCR method can be performed as follows. Total cellular RNA is isolated by, for example, the standard guanidium isothiocyanate method and the total RNA is reverse transcribed. The reverse transcription method involves synthesis of DNA on a template of RNA using a reverse transcriptase enzyme and a 3' end oligonucleotide dT primer and/or random hexamer primers. The cDNA thus produced is then amplified by means of PCR. (Belyaysky et al, Nucl Acid Res 17:2919-2932, 1989; Krug and Berger, Methods in Enzymology, Academic Press, N.Y., Vol. 152, pp. 316-325, 1987 which are incorporated by reference). Further preferred is the "Real-time" variant of RT-PCR, wherein the PCR product is detected by means of hybridization probes (e.g. TaqMan, LightCycler, Molecular Beacons and Scorpion) or SYBR green. The detected signal from the probes or SYBR green is then quantitated either by reference to a standard curve or by comparing the Ct values to that of a calibration standard. Analysis of housekeeping genes is often used to normalize the results.

In Northern blot analysis total or poly(A)+ mRNA is run on a denaturing agarose gel and detected by hybridisation to a labelled probe in the dried gel itself or on a membrane. The resulting signal is proportional to the amount of target RNA in the RNA population.

Comparing the signals from two or more cell populations or tissues reveals relative differences in gene expression levels. Absolute quantitation can be performed by comparing the signal to a standard curve generated using known amounts of an in vitro transcript corresponding to the target RNA. Analysis of housekeeping genes, genes whose expression levels are expected to remain relatively constant regardless of conditions, is often used to normalize the results, eliminating any apparent differences caused by unequal transfer of RNA to the membrane or unequal loading of RNA on the gel.

The first step in Northern analysis is isolating pure, intact RNA from the cells or tissue of interest. Because Northern blots distinguish RNAs by size, sample integrity influences the degree to which a signal is localized in a single band. Partially degraded RNA samples will result in the signal being smeared or distributed over several bands with an overall loss in sensitivity and possibly an erroneous interpretation of the data. In Northern blot analysis, DNA, RNA and oligonucleotide probes can be used and these probes are preferably labelled (e.g. radioactive labels, mass labels or fluorescent labels). The size of the target RNA, not the probe, will determine the size of the detected band, so methods such as random-primed labelling, which generates probes of variable lengths, are suitable for probe synthesis. The specific activity of the probe will determine the level of sensitivity, so it is preferred that probes with high specific activities, are used.

In an RNase protection assay, the RNA target and an RNA probe of a defined length are hybridised in solution. Following hybridisation, the RNA is digested with RNases specific for single-stranded nucleic acids to remove any unhybridized, single-stranded target RNA and probe. The RNases are inactivated, and the RNA is separated e.g. by denaturing polyacrylamide gel electrophoresis. The amount of intact RNA probe is proportional to the amount of target RNA in the RNA population. RPA can be used for relative and absolute quantitation of gene expression and also for mapping RNA structure, such as intron/exon boundaries and transcription start sites. The RNase protection assay is preferable to Northern blot analysis as it generally has a lower limit of detection.

The antisense RNA probes used in RPA are generated by in vitro transcription of a DNA template with a defined endpoint and are typically in the range of 50-600 nucleotides. The use of RNA probes that include additional sequences not homologous to the target RNA allows the protected fragment to be distinguished from the full-length probe. RNA probes are typically used instead of DNA probes due to the ease of generating single-stranded RNA probes and the reproducibility and reliability of RNA:RNA duplex digestion with RNases (Ausubel et al. 2003), particularly preferred are probes with high specific activities.

Particularly preferred is the use of microarrays. The microarray analysis process can be divided into two main parts. First is the immobilization of known gene sequences onto glass slides or other solid support followed by hybridisation of the fluorescently labelled cDNA (comprising the sequences to be interrogated) to the known genes immobilized on the glass slide (or other solid phase). After hybridisation, arrays are scanned using a fluorescent microarray scanner. Analysing the relative fluorescent intensity of different genes provides a measure of the differences in gene expression.

DNA arrays can be generated by immobilizing pre-synthesized oligonucleotides onto prepared glass slides or other solid surfaces. In this case, representative gene sequences are manufactured and prepared using standard oligonucleotide synthesis and purification methods. These synthesized gene sequences are complementary to the RNA transcript(s) of at least one gene selected from the group consisting of CDO1; APC; BMPR1A; CTAGE5; CXCL12; NCR1; NFATC2; PAX9; POU4F3; and ZBTB16 and tend to be shorter sequences in the range of 25-70 nucleotides. Alternatively, immobilized oligonucleotides can be chemically synthesized in situ on the surface of the slide. In situ oligonucleotide synthesis involves the consecutive addition of the appropriate nucleotides to the spots on the microarray;

spots not receiving a nucleotide are protected during each stage of the process using physical or virtual masks. Preferably said synthesized nucleic acids are locked nucleic acids.

In expression profiling microarray experiments, the RNA templates used are representative of the transcription profile of the cells or tissues under study. RNA is first isolated from the cell populations or tissues to be compared. Each RNA sample is then used as a template to generate fluorescently labelled cDNA via a reverse transcription reaction. Fluorescent labelling of the cDNA can be accomplished by either direct labelling or indirect labelling methods. During direct labelling, fluorescently modified nucleotides (e.g., Cy®3- or Cy®5-dCTP) are incorporated directly into the cDNA during the reverse transcription. Alternatively, indirect labelling can be achieved by incorporating aminoallyl-modified nucleotides during cDNA synthesis and then conjugating an N-hydroxysuccinimide (NHS)-ester dye to the aminoallyl-modified cDNA after the reverse transcription reaction is complete. Alternatively, the probe may be unlabelled, but may be detectable by specific binding with a ligand which is labelled, either directly or indirectly. Suitable labels and methods for labelling ligands (and probes) are known in the art, and include, for example, radioactive labels which may be incorporated by known methods (e.g., nick translation or kinasing). Other suitable labels include but are not limited to biotin, fluorescent groups, chemiluminescent groups (e.g., dioxetanes, particularly triggered dioxetanes), enzymes, antibodies, and the like.

To perform differential gene expression analysis, cDNA generated from different RNA samples are labelled with Cy®3. The resulting labelled cDNA is purified to remove unincorporated nucleotides, free dye and residual RNA. Following purification, the labelled cDNA samples are hybridised to the microarray. The stringency of hybridisation is determined by a number of factors during hybridisation and during the washing procedure, including temperature, ionic strength, length of time and concentration of formamide. These factors are outlined in, for example, Sambrook et al. (Molecular Cloning: A Laboratory Manual, 2nd ed., 1989). The microarray is scanned post-hybridisation using a fluorescent microarray scanner. The fluorescent intensity of each spot indicates the level of expression of the analysed gene; bright spots correspond to strongly expressed genes, while dim spots indicate weak expression.

Once the images are obtained, the raw data must be analysed. First, the background fluorescence must be subtracted from the fluorescence of each spot. The data is then normalized to a control sequence, such as exogenously added nucleic acids (preferably RNA or DNA), or a housekeeping gene panel to account for any non-specific hybridisation, array imperfections or variability in the array set-up, cDNA labelling, hybridisation or washing. Data normalization allows the results of multiple arrays to be compared.

Another aspect of the invention relates to a kit for use in determining the prognosis of a subject having cell proliferative disorder, preferably cancer according to the methods of the present invention, said kit comprising: a means for measuring the level of transcription of at least one gene selected from the group consisting of CDO1; APC; BMPR1A; CTAGE5; CXCL12; NCR1; NFATC2; PAX9; POU4F3; and ZBTB16. In a preferred embodiment the means for measuring the level of transcription comprise oligonucleotides or polynucleotides able to hybridise under stringent or moderately stringent conditions to the transcription products of at least one gene selected from the group consisting of CDO1; APC; BMPR1A; CTAGE5; CXCL12; NCR1; NFATC2; PAX9; POU4F3; and ZBTB16. In a most preferred embodiment the level of transcription is determined by techniques selected from the group of Northern Blot analysis, reverse transcriptase PCR, real-time PCR, RNAse protection, and microarray. In another embodiment of the invention the kit further comprises means for obtaining and/or storing a biological sample of the subject. Preferred is a kit, which further comprises a container which is most preferably suitable for containing the means for measuring the level of transcription and the biological sample of the subject, and most preferably further comprises instructions for use and interpretation of the kit results.

In a preferred embodiment the kit comprises (a) a plurality of oligonucleotides or polynucleotides able to hybridise under stringent or moderately stringent conditions to the transcription products of at least one gene selected from the group consisting of CDO1; APC; BMPR1A; CTAGE5; CXCL12; NCR1; NFATC2; PAX9; POU4F3; and ZBTB16 (b) a container, preferably suitable for containing the oligonucleotides or polynucleotides and a biological sample of the subject comprising the transcription products wherein the oligonucleotides or polynucleotides can hybridise under stringent or moderately stringent conditions to the transcription products, (c) means to detect the hybridisation of (b); and optionally, (d) instructions for use and interpretation of the kit results The kit may also contain other components such as hybridisation buffer (where the oligonucleotides are to be used as a probe) packaged in a separate container. Alternatively, where the oligonucleotides are to be used to amplify a target region, the kit may contain, packaged in separate containers, a polymerase and a reaction buffer optimised for primer extension mediated by the polymerase, such as PCR. Preferably said polymerase is a reverse transcriptase. It is further preferred that said kit further contains an Rnase reagent.

The present invention further provides for methods for the detection of the presence of the polypeptide encoded by said gene sequences in a sample obtained from said subject.

Aberrant levels of polypeptide expression of the polypeptides encoded at least one gene selected from the group consisting of CDO1; APC; BMPR1A; CTAGE5; CXCL12; NCR1; NFATC2; PAX9; POU4F3; ZBTB16 are associated with the prognosis of a subject having cell proliferative disorder, preferably cancer.

According to the present invention under-expression of said polypeptides is associated with a negative prognosis of a subject having cell proliferative disorder, preferably cancer.

Any method known in the art for detecting polypeptides can be used. Such methods include, but are not limited to mass-spectrometry, immunodiffusion, immunoelectrophoresis, immunochemical methods, binder-ligand assays, immunohistochemical techniques, agglutination and complement assays (e.g., see Basic and Clinical Immunology, Sites and Terr, eds., Appleton and Lange, Norwalk, Conn. pp 217-262, 1991 which is incorporated by reference). Preferred are binder-ligand immunoassay methods including reacting antibodies with an epitope or epitopes and competitively displacing a labelled polypeptide or derivative thereof.

Certain embodiments of the present invention comprise the use of antibodies specific to the polypeptide(s) encoded by at least one gene selected from the group consisting of CDO1; APC; BMPR1A; CTAGE5; CXCL12; NCR1; NFATC2; PAX9; POU4F3; and ZBTB16.

Such antibodies are useful for determining the prognosis of a subject having cell proliferative disorder, preferably cancer. In certain embodiments production of monoclonal or polyclonal antibodies can be induced by the use of an epitope encoded by a polypeptide of at least one gene selected from the group consisting of CDO1; APC; BMPR1A; CTAGE5; CXCL12; NCR1; NFATC2; PAX9; POU4F3; and ZBTB16 as an antigen. Such antibodies may in turn be used to detect expressed polypeptides. The levels of such polypeptides present may be quantified by conventional methods. Antibody-polypeptide binding may be detected and quantified by a variety of means known in the art, such as labelling with fluorescent or radioactive ligands. The invention further comprises kits for performing the above-mentioned procedures, wherein such kits contain antibodies specific for the investigated polypeptides.

Numerous competitive and non-competitive polypeptide binding immunoassays are well known in the art. Antibodies employed in such assays may be unlabelled, for example as used in agglutination tests, or labelled for use a wide variety of assay methods. Labels that can be used include radionuclides, enzymes, fluorescers, chemiluminescers, enzyme substrates or co-factors, enzyme inhibitors, particles, dyes and the like. Preferred assays include but are not limited to radioimmunoassay (RIA), enzyme immunoassays, e.g., enzyme-linked immunosorbent assay (ELISA), fluorescent immunoassays and the like. Polyclonal or monoclonal antibodies or epitopes thereof can be made for use in immunoassays by any of a number of methods known in the art.

In an alternative embodiment of the method the proteins may be detected by means of western blot analysis. Said analysis is standard in the art, briefly proteins are separated by means of electrophoresis e.g. SDS-PAGE. The separated proteins are then transferred to a suitable membrane (or paper) e.g. nitrocellulose, retaining the spacial separation achieved by electrophoresis. The membrane is then incubated with a blocking agent to bind remaining sticky places on the membrane, commonly used agents include generic protein (e.g. milk protein). An antibody specific to the protein of interest is then added, said antibody being detectably labelled for example by dyes or enzymatic means (e.g. alkaline phosphatase or horseradish peroxidase). The location of the antibody on the membrane is then detected.

In an alternative embodiment of the method the proteins may be detected by means of immunohistochemistry (the use of antibodies to probe specific antigens in a sample). Said analysis is standard in the art, wherein detection of antigens in tissues is known as immunohistochemistry, while detection in cultured cells is generally termed immunocytochemistry. Briefly the primary antibody to be detected by binding to its specific antigen. The antibody-antigen complex is then bound by a secondary enzyme conjugated antibody. In the presence of the necessary substrate and chromogen the bound enzyme is detected according to coloured deposits at the antibody-antigen binding sites. There is a wide range of suitable sample types, antigen-antibody affinity, antibody types, and detection enhancement methods. Thus optimal conditions for immunohistochemical or immunocytochemical detection must be determined by the person skilled in the art for each individual case.

One approach for preparing antibodies to a polypeptide is the selection and preparation of an amino acid sequence of all or part of the polypeptide, chemically synthesising the amino acid sequence and injecting it into an appropriate animal, usually a rabbit or a mouse (Milstein and Kohler Nature 256:495-497, 1975; Gulfre and Milstein, Methods in Enzymology: Immunochemical Techniques 73:1-46, Langone and Banatis eds., Academic Press, 1981 which are incorporated by reference in its entirety). Methods for preparation of the polypeptides or epitopes thereof include, but are not limited to chemical synthesis, recombinant DNA techniques or isolation from biological samples.

In the final step of the method the prognosis of the subject is determined, whereby under-expression (of mRNA or polypeptides) is indicative of the prognosis of a subject having cell proliferative disorder, preferably cancer. The term under-expression shall be taken to mean expression at a detected level less than a pre-determined cut off which may be selected from the group consisting of the mean, median or an optimised threshold value. The term over-expression shall be taken to mean expression at a detected level greater than a pre-determined cut off which may be selected from the group consisting of the mean, median or an optimised threshold value.

Another aspect of the invention provides a kit for use in determining the prognosis of a subject having cell proliferative disorder, preferably cancer according to the methods of the present invention, comprising: a means for detecting at least one gene selected from the group consisting of CDO1; APC; BMPR1A; CTAGE5; CXCL12; NCR1; NFATC2; PAX9; POU4F3; and ZBTB16 polypeptides. The means for detecting the polypeptides comprise preferably antibodies, antibody derivatives, or antibody fragments. The polypeptides are most preferably detected by means of Western Blotting utilizing a labelled antibody. In another embodiment of the invention the kit further comprising means for obtaining a biological sample of the subject. Preferred is a kit, which further comprises a container suitable for containing the means for detecting the polypeptides in the biological sample of the subject, and most preferably further comprises instructions for use and interpretation of the kit results. In a preferred embodiment the kit comprises: (a) a means for detecting at least one gene selected from the group consisting of CDO1; APC; BMPR1A; CTAGE5; CXCL12; NCR1; NFATC2; PAX9; POU4F3; and ZBTB16 polypeptides; (b) a container suitable for containing the said means and the biological sample of the subject comprising the polypeptides wherein the means can form complexes with the polypeptides; (c) a means to detect the complexes of (b); and optionally (d) instructions for use and interpretation of the kit results.

The kit may also contain other components such as buffers or solutions suitable for blocking, washing or coating, packaged in a separate container.

Methylation Analysis

Particular embodiments of the present invention provide a novel application of the analysis of methylation levels and/or patterns within at least one gene selected from the group consisting of CDO1; APC; BMPR1A; CTAGE5; CXCL12; NCR1; NFATC2; PAX9; POU4F3; and ZBTB16 that enables determination of the prognosis of a subject having cell proliferative disorder, preferably cancer. Determination of the prognosis of a patient having cell proliferative disorder, preferably cancer enables the physician to make better and more informed treatment decisions. In one embodiment said prognosis is the subject's prognosis subsequent to a therapy comprising at least one anthracycline.

In the most preferred embodiment of the method, the prognosis of a subject having cell proliferative disorder, preferably cancer is determined by analysis of the methylation status of one or more CpG dinucleotides of at least one gene selected from the group consisting of CDO1; APC; BMPR1A; CTAGE5; CXCL12; NCR1; NFATC2; PAX9; POU4F3; and ZBTB16.

In one embodiment the invention of said method comprises the following steps: i) contacting genomic DNA (preferably isolated from cell lines, histological slides, paraffin embedded tissues, biopsies, tissue embedded in paraffin, bodily fluids (such as but not limited to nipple aspirate and blood) and all possible combinations thereof) obtained from the subject with at least one reagent, or series of reagents that distinguishes between methylated and non-methylated CpG dinucleotides within at least one gene selected from the group consisting of CDO1; APC; BMPR1A; CTAGE5; CXCL12; NCR1; NFATC2; PAX9; POU4F3; and ZBTB16 (including promoter and regulatory regions thereof) and ii) determining the prognosis of said subject having cell proliferative disorder, preferably cancer.

It is preferred that said one or more CpG dinucleotides of at least one gene selected from the group consisting of CDO1; APC; BMPR1A; CTAGE5; CXCL12; NCR1; NFATC2; PAX9; POU4F3; and ZBTB16 are comprised within a respective genomic target sequence thereof as provided in SEQ ID NO: 1-10, or preferred regions thereof according to SEQ ID NO: 11-20 and complements thereof. The present invention further provides a method for ascertaining genetic and/or epigenetic parameters of at least one gene selected from the group consisting of CDO1; APC; BMPR1A; CTAGE5; CXCL12; NCR1; NFATC2; PAX9; POU4F3; and ZBTB16 and/or the genomic sequence according to SEQ ID NO: 1-10, or preferred regions thereof according to SEQ ID NO: 11-20 within a subject by analyzing cytosine methylation. Said method comprising contacting a nucleic acid comprising SEQ ID NO: 1-10, or preferred regions thereof according to SEQ ID NO: 11-20 in a biological sample obtained from said subject with at least one reagent or a series of reagents, wherein said reagent or series of reagents, distinguishes between methylated and non-methylated CpG dinucleotides within the target nucleic acid.

In a preferred embodiment, said method comprises the following steps: In the first step, a sample of the tissue to be analyzed is obtained. The source may be any suitable source, such as cell lines, histological slides, paraffin embedded tissues, biopsies, tissue embedded in paraffin, bodily fluids (such as but not limited to nipple aspirate and blood) and all possible combinations thereof and all possible combinations thereof. It is preferred that said sources of DNA are cell lines, histological slides, paraffin embedded tissues, biopsies, tissue embedded in paraffin, bodily fluids (such as but not limited to nipple aspirate and blood) and all possible combinations thereof.

The genomic DNA is then isolated from the sample. Genomic DNA may be isolated by any means standard in the art, including the use of commercially available kits. Briefly, wherein the DNA of interest is encapsulated in by a cellular membrane the biological sample must be disrupted and lysed by enzymatic, chemical or mechanical means. The DNA solution may then be cleared of proteins and other contaminants e.g. by digestion with proteinase K. The genomic DNA is then recovered from the solution. This may be carried out by means of a variety of methods including salting out, organic extraction or binding of the DNA to a solid phase support. The choice of method will be affected by several factors including time, expense and required quantity of DNA.

Wherein the sample DNA is not enclosed in a membrane (e.g. circulating DNA from a blood sample) methods standard in the art for the isolation and/or purification of DNA may be employed. Such methods include the use of a protein degenerating reagent e.g. chaotropic salt e.g. guanidine hydrochloride or urea; or a detergent e.g. sodium dodecyl sulphate (SDS), cyanogen bromide. Alternative methods include but are not limited to ethanol precipitation or propanol precipitation, vacuum concentration amongst others by means of a centrifuge. The person skilled in the art may also make use of devices such as filter devices e.g. ultrafiltration, silica surfaces or membranes, magnetic particles, polystyrene particles, polystyrene surfaces, positively charged surfaces, and positively charged membranes, charged membranes, charged surfaces, charged switch membranes, charged switched surfaces.

Once the nucleic acids have been extracted, the genomic double stranded DNA is used in the analysis, methylation analysis may be carried out by any means known in the art including but not limited to methylation sensitive restriction enzyme analysis and chemical reagent analysis.

Chemical Analysis

In the second step of the method, the genomic DNA sample is treated in such a manner that cytosine bases which are unmethylated at the 5'-position are converted to uracil, thymine, or another base which is dissimilar to cytosine in terms of hybridization behavior. This will be understood as 'pre-treatment' or 'treatment' herein.

This is preferably achieved by means of treatment with a bisulfite reagent. The term "bisulfite reagent" refers to a reagent comprising bisulfite, disulfite, hydrogen sulfite or combinations thereof, useful as disclosed herein to distinguish between methylated and unmethylated CpG dinucleotide sequences. Methods of said treatment are known in the art (e.g. PCT/EP2004/011715, which is incorporated by reference in its entirety). It is preferred that the bisulfite treatment is conducted in the presence of denaturing solvents such as but not limited to n-alkylenglycol, particularly diethylene glycol dimethyl ether (DME), or in the presence of dioxane or dioxane derivatives. In a preferred embodiment the denaturing solvents are used in concentrations between 1% and 35% (v/v). It is also preferred that the bisulfite reaction is carried out in the presence of scavengers such as but not limited to chromane derivatives, e.g., 6-hydroxy-2, 5,7,8, -tetramethylchromane 2-carboxylic acid or trihydroxybenzoe acid and derivates thereof, e.g. Gallic acid (see: PCT/EP2004/011715 which is incorporated by reference in its entirety). The bisulfite conversion is preferably carried out at a reaction temperature between 30° C. and 70° C., whereby the temperature is increased to over 85° C. for short periods of times during the reaction (see: PCT/EP2004/011715 which is incorporated by reference in its entirety). The bisulfite treated DNA is preferably purified priori to the quantification. This may be conducted by any means known in the art, such as but not limited to ultrafiltration, preferably carried out by means of Microcon^™ columns (manufactured by Millipore^™). The purification is carried out according to a modified manufacturer's protocol (see: WO 2005/038051 which is incorporated by reference in its entirety).

In the third step of the method, fragments of the treated DNA are amplified, using sets of primer oligonucleotides according to the present invention, and an amplification enzyme. The amplification of several DNA segments can be carried out simultaneously in one and the same reaction vessel. Typically, the amplification is carried out using a polymerase chain reaction (PCR). Preferably said amplificates are 100 to 2,000 base pairs in length. The set of primer oligonucleotides includes at least two oligonucleotides whose sequences are each reverse complementary, identical, or hybridize under stringent or highly stringent conditions to an at least 16-base-pair long segment of the base sequences of one of SEQ ID NO: 21-40 and 61-80 or preferred regions thereof according to SEQ ID NO: 41-60 and 81-100 and sequences complementary thereto.

In an alternate embodiment of the method, the methylation status of pre-selected CpG positions within at least one gene selected from the group consisting of CDO1; APC; BMPR1A; CTAGE5; CXCL12; NCR1; NFATC2; PAX9; POU4F3; and ZBTB16 and preferably within the nucleic acid sequences according to SEQ ID NO: 1-10, or preferred regions thereof according to SEQ ID NO: 11-20, may be detected by use of methylation-specific primer oligonucleotides. This technique (MSP) has been described in U.S. Pat. No. 6,265,171 to Herman. The use of methylation status specific primers for the amplification of bisulfite treated DNA allows the differentiation between methylated and unmethylated nucleic acids. MSP primers pairs contain at least one primer which hybridizes to a bisulfite treated CpG dinucleotide. Therefore, the sequence of said primers comprises at least one CpG dinucleotide. MSP primers specific for non-methylated DNA contain a "T" at the position of the C position in the CpG. Preferably, therefore, the base sequence of said primers is required to comprise a sequence having a length of at least 9 nucleotides which hybridizes to a treated nucleic acid sequence according to one of SEQ ID NO: 21-40 and 61-80 or preferred regions thereof according to SEQ ID NO: 41-60 and 81-100 and sequences complementary thereto, wherein the base sequence of said oligomers comprises at least one CpG dinucleotide.A further preferred embodiment of the method comprises the use of blocker oligonucleotides (the HeavyMethyl™ assay). The use of such blocker oligonucleotides has been described by Yu et al., BioTechniques 23:714-720, 1997. Blocking probe oligonucleotides are hybridized to the bisulfite treated nucleic acid concurrently with the PCR primers. PCR amplification of the nucleic acid is terminated at the 5' position of the blocking probe, such that amplification of a nucleic acid is suppressed where the complementary sequence to the blocking probe is present. The probes may be designed to hybridize to the bisulfite treated nucleic acid in a methylation status specific manner. For example, for detection of methylated nucleic acids within a population of unmethylated nucleic acids, suppression of the amplification of nucleic acids which are unmethylated at the position in question would be carried out by the use of blocking probes comprising a 'CpA' or 'TpA' at the position in question, as opposed to a 'CpG' if the suppression of amplification of methylated nucleic acids is desired.

For PCR methods using blocker oligonucleotides, efficient disruption of polymerase-mediated amplification requires that blocker oligonucleotides not be elongated by the polymerase. Preferably, this is achieved through the use of blockers that are 3'-deoxyoligonucleotides, or oligonucleotides derivitized at the 3' position with other than a "free" hydroxyl group. For example, 3'-O-acetyl oligonucleotides are representative of a preferred class of blocker molecule.

Additionally, polymerase-mediated decomposition of the blocker oligonucleotides should be precluded. Preferably, such preclusion comprises either use of a polymerase lacking 5'-3' exonuclease activity, or use of modified blocker oligonucleotides having, for example, thioate bridges at the 5'-terminii thereof that render the blocker molecule nuclease-resistant. Particular applications may not require such 5' modifications of the blocker. For example, if the blocker- and primer-binding sites overlap, thereby precluding binding of the primer (e.g., with excess blocker), degradation of the blocker oligonucleotide will be substantially precluded. This is because the polymerase will not extend the primer toward, and through (in the 5'-3' direction) the blocker—a process that normally results in degradation of the hybridized blocker oligonucleotide.

A particularly preferred blocker/PCR embodiment, for purposes of the present invention and as implemented herein, comprises the use of peptide nucleic acid (PNA) oligomers as blocking oligonucleotides. Such PNA blocker oligomers are ideally suited, because they are neither decomposed nor extended by the polymerase.

Preferably, therefore, the base sequence of said blocking oligonucleotides is required to comprise a sequence having a length of at least 9 nucleotides which hybridizes to a treated nucleic acid sequence according to one of SEQ ID NO: 21-40 and 61-80 or preferred regions thereof according to SEQ ID NO: 41-60 and 81-100 and sequences complementary thereto, wherein the base sequence of said oligonucleotides comprises at least one CpG, TpG or CpA dinucleotide. It is particularly preferred that the base sequence of said blocking oligonucleotides is required to comprise a sequence having a length of at least 9 nucleotides which hybridizes to a treated nucleic acid sequence according to one of SEQ ID NO: 61-80 or preferred regions thereof according to SEQ ID NO: 81-100 and sequences complementary thereto, wherein the base sequence of said oligonucleotides comprises at least one TpG or CpA dinucleotide.

The fragments obtained by means of the amplification can carry a directly or indirectly detectable label. Preferred are labels in the form of fluorescence labels, radionuclides, or detachable molecule fragments having a typical mass which can be detected in a mass spectrometer. Where said labels are mass labels, it is preferred that the labeled amplificates have a single positive or negative net charge, allowing for better delectability in the mass spectrometer. The detection may be carried out and visualized by means of, e.g., matrix assisted laser desorption/ionization mass spectrometry (MALDI) or using electron spray mass spectrometry (ESI).

Matrix Assisted Laser Desorption/Ionization Mass Spectrometry (MALDI-TOF) is a very efficient development for the analysis of biomolecules (Karas and Hillenkamp, Anal Chem., 60:2299-301, 1988). An analyte is embedded in a light-absorbing matrix. The matrix is evaporated by a short laser pulse thus transporting the analyte molecule into the vapor phase in an unfragmented manner. The analyte is ionized by collisions with matrix molecules. An applied voltage accelerates the ions into a field-free flight tube. Due to their different masses, the ions are accelerated at different rates. Smaller ions reach the detector sooner than bigger ones. MALDI-TOF spectrometry is well suited to the analysis of peptides and proteins. The analysis of nucleic acids is somewhat more difficult (Gut and Beck, Current Innovations and Future Trends, 1:147-57, 1995). The sensitivity with respect to nucleic acid analysis is approximately 100-times less than for peptides, and decreases disproportionally with increasing fragment size. Moreover, for nucleic acids having a multiply negatively charged backbone, the ionization process via the matrix is considerably less efficient. In MALDI-TOF spectrometry, the selection of the matrix plays an eminently important role. For desorption of peptides, several very efficient matrixes have been found which produce a very fine crystallization. There are now several responsive matrixes for DNA, however, the difference in sensitivity between peptides and nucleic acids has not been reduced. This difference in sensitivity can be reduced, however, by chemically modifying the DNA in such a manner that it becomes more similar to a peptide. For example, phosphorothioate nucleic acids, in which the usual phosphates of the backbone are substituted with thiophosphates, can be converted into a charge-neutral DNA using simple alkylation chemistry (Gut and Beck, *Nucleic Acids Res.* 23: 1367-73, 1995). The coupling of a charge tag to this modified DNA results in an increase in MALDI-TOF sensitivity to the same level as that found for peptides. A further advantage of charge tagging is the increased stability of the analysis against impurities, which makes the detection of unmodified substrates considerably more difficult.

In the fourth step of the method, the amplificates obtained during the third step of the method are analyzed in order to ascertain the methylation status of the CpG dinucleotides prior to the treatment.

In embodiments where the amplificates were obtained by means of MSP amplification, the presence, absence or class of an amplificate is in itself indicative of the methylation state of the CpG positions covered by the primer, according to the base sequences of said primer.

Amplificates obtained by means of both standard and methylation specific PCR may be further analyzed by means of based-based methods such as, but not limited to, array technology and probe based technologies as well as by means of techniques such as sequencing and template directed extension.

In one embodiment of the method, the amplificates synthesized in step three are subsequently hybridized to an array or a set of oligonucleotides and/or PNA probes. In this context, the hybridization takes place in the following manner: the set of probes used during the hybridization is preferably composed of at least 2 oligonucleotides or PNA-oligomers; in the process, the amplificates serve as probes which hybridize to oligonucleotides previously bonded to a solid phase; the non-hybridized fragments are subsequently removed; said oligonucleotides contain at least one base sequence having a length of at least 9 nucleotides which is reverse complementary or identical to a segment of the base sequences specified in the present Sequence Listing; and the segment comprises at least one CpG, TpG or CpA dinucleotide. The hybridizing portion of the hybridizing nucleic acids is typically at least 9, 15, 20, 25, 30 or 35 nucleotides in length. However, longer molecules have inventive utility, and are thus within the scope of the present invention.

In a preferred embodiment, said dinucleotide is present in the central third of the oligomer. For example, wherein the oligomer comprises one CpG dinucleotide, said dinucleotide is preferably the fifth to ninth nucleotide from the 5'-end of a 13-mer. One oligonucleotide exists for the analysis of each CpG dinucleotide within a sequence selected from the group consisting SEQ ID NO: 1-10, or preferred regions thereof according to SEQ ID NO: 11-20, and the equivalent positions within SEQ ID NO: 21-40 and 61-80 or preferred regions thereof according to SEQ ID NO: 41-60 and 81-100. Said oligonucleotides may also be present in the form of peptide nucleic acids. The non-hybridized amplificates are then removed. The hybridized amplificates are then detected. In this context, it is preferred that labels attached to the amplificates are identifiable at each position of the solid phase at which an oligonucleotide sequence is located.

In yet a further embodiment of the method, the genomic methylation status of the CpG positions may be ascertained by means of oligonucleotide probes (as detailed above) that are hybridized to the bisulfite treated DNA concurrently with the PCR amplification primers (wherein said primers may either be methylation specific or standard).

A particularly preferred embodiment of this method is the use of fluorescence-based Real Time Quantitative PCR (Heid et al., *Genome Res.* 6:986-994, 1996; also see U.S. Pat. No. 6,331,393) employing a dual-labeled fluorescent oligonucleotide probe (TaqMan™ PCR, using an ABI Prism 7700 Sequence Detection System, Perkin Elmer Applied Biosystems, Foster City, Calif.). The TaqMan™ PCR reaction employs the use of a non-extendible interrogating oligonucleotide, called a TaqMan™ probe, which, in preferred embodiments, is designed to hybridize to a CpG-rich sequence located between the forward and reverse amplification primers. The TaqMan™ probe further comprises a fluorescent "reporter moiety" and a "quencher moiety" covalently bound to linker moieties (e.g., phosphoramidites) attached to the nucleotides of the TaqMan™ oligonucleotide. For analysis of methylation within nucleic acids subsequent to bisulfite treatment, it is required that the probe be methylation specific, as described in U.S. Pat. No. 6,331,393, (hereby incorporated by reference in its entirety) also known as the MethyLightTM™ assay. Variations on the TaqMann™ detection methodology that are also suitable for use with the described invention include the use of dual-probe technology (LightCycler™) or fluorescent amplification primers (Sunrise™ technology). Both these techniques may be adapted in a manner suitable for use with bisulfite treated DNA, and moreover for methylation analysis within CpG dinucleotides.

In a further preferred embodiment of the method, the fourth step of the method comprises the use of template-directed oligonucleotide extension, such as MS-SNuPE as described by Gonzalgo and Jones, *Nucleic Acids Res.* 25:2529-2531, 1997.

In yet a further embodiment of the method, the fourth step of the method comprises sequencing and subsequent sequence analysis of the amplificate generated in the third step of the method (Sanger F., et al., *Proc Natl Acad Sci USA* 74:5463-5467, 1977).

In the most preferred embodiment of the method the genomic nucleic acids are isolated and treated according to the first three steps of the method outlined above, namely:
  a) obtaining, from a subject, a biological sample having subject genomic DNA;
  b) extracting or otherwise isolating the genomic DNA;
  c) treating the genomic DNA of b), or a fragment thereof, with one or more reagents to convert cytosine bases that are unmethylated in the 5-position thereof to uracil or to another base that is detectably dissimilar to cytosine in terms of hybridization properties; and wherein
  d) amplifying subsequent to treatment in c) is carried out in a methylation specific manner, namely by use of methylation specific primers or blocking oligonucleotides, and further wherein
  e) detecting of the amplificates is carried out by means of a real-time detection probe, as described above.

Preferably, where the subsequent amplification of d) is carried out by means of methylation specific primers, as described above, said methylation specific primers comprise a sequence having a length of at least 9 nucleotides which hybridizes to a treated nucleic acid sequence according to one of SEQ ID NO: 21-40 and 61-80 or preferred regions thereof according to SEQ ID NO: 41-60 and 81-100 and sequences complementary thereto, wherein the base sequence of said oligomers comprise at least one CpG dinucleotide.

Step e) of the method, namely the detection of the specific amplificates indicative of the methylation status of one or more CpG positions according to SEQ ID NO: 1-10, or preferred regions thereof according to SEQ ID NO: 11-20 is carried out by means of real-time detection methods as described above.

Methylation Sensitive Restriction Enzyme Analysis

In an alternative embodiment of the invention the above described second step may be carried out by means of methylation sensitive or methylation specific restriction enzyme analysis. Methods are known in the art wherein a methylation sensitive restriction enzyme reagent, or a series of restriction enzyme reagents comprising methylation sensitive restriction enzyme reagents that distinguishes between methylated and non-methylated CpG dinucleotides within a target region are utilized in determining methylation, for example but not limited to DMH.

In a preferred embodiment, the DNA may be cleaved prior to treatment with methylation sensitive restriction enzymes. Such methods are known in the art and may include both physical and enzymatic means. Particularly preferred is the use of one or a plurality of restriction enzymes which are not methylation sensitive, and whose recognition sites are AT rich and do not comprise CG dinucleotides. The use of such enzymes enables the conservation of CpG islands and CpG rich regions in the fragmented DNA. The non-methylation-specific restriction enzymes are preferably selected from the group consisting of MseI, BfaI, Csp6I, Tru1I, Tvu1I, Tru9I, Tvu9I, MaeI and XspI. Particularly preferred is the use of two or three such enzymes. Particularly preferred is the use of a combination of MseI, BfaI and Csp6I.

The fragmented DNA may then be ligated to adaptor oligonucleotides in order to facilitate subsequent enzymatic amplification. The ligation of oligonucleotides to blunt and sticky ended DNA fragments is known in the art, and is carried out by means of dephosphorylation of the ends (e.g. using calf or shrimp alkaline phosphatase) and subsequent ligation using ligase enzymes (e.g. T4 DNA ligase) in the presence of dATPs. The adaptor oligonucleotides are typically at least 18 base pairs in length.

In the third step, the DNA (or fragments thereof) is then digested with one or more methylation sensitive restriction enzymes. The digestion is carried out such that hydrolysis of the DNA at the restriction site is informative of the methylation status of a specific CpG dinucleotide of at least one gene selected from the group consisting of CDO1; APC; BMPR1A; CTAGE5; CXCL12; NCR1; NFATC2; PAX9; POU4F3; and ZBTB16.

Preferably, the methylation-specific restriction enzyme is selected from the group consisting of Bsi EI, Hga I HinPI, Hpy99I, Ave I, Bce AI, Bsa HI, BisI, BstUI, Bsh1236I, AccII, BstFNI, McrBC, GlaI, MvnI, HpaII (HapII), HhaI, AciI, SmaI, HinP1I, HpyCH4IV, EagI and mixtures of two or more of the above enzymes. Preferred is a mixture containing the restriction enzymes BstUI, HpaII, HpyCH4IV and HinP1I.

In the fourth step, which is optional but a preferred embodiment, the restriction fragments are amplified. This is preferably carried out using a polymerase chain reaction, and said amplificates may carry suitable detectable labels as discussed above, namely fluorophore labels, radionuclides and mass labels. Particularly preferred is amplification by means of an amplification enzyme and at least two primers comprising, in each case a contiguous sequence at least 16 nucleotides in length that is complementary to, or hybridizes under moderately stringent or stringent conditions to a sequence selected from the group consisting SEQ ID NO: 1-10, or preferred regions thereof according to SEQ ID NO: 11-20, and complements thereof. Preferably said contiguous sequence is at least 16, 20 or 25 nucleotides in length. In an alternative embodiment said primers may be complementary to any adaptors linked to the fragments.

In the fifth step the amplificates are detected. The detection may be by any means standard in the art, for example, but not limited to, gel electrophoresis analysis, hybridization analysis, incorporation of detectable tags within the PCR products, DNA array analysis, MALDI or ESI analysis. Preferably said detection is carried out by hybridization to at least one nucleic acid or peptide nucleic acid comprising in each case a contiguous sequence at least 16 nucleotides in length that is complementary to, or hybridizes under moderately stringent or stringent conditions to a sequence selected from the group consisting SEQ ID NO: 1-10, or preferred regions thereof according to SEQ ID NO: 11-20, and complements thereof. Preferably said contiguous sequence is at least 16, 20 or 25 nucleotides in length.

Subsequent to the determination of the methylation state or level of the genomic nucleic acids the prognosis of a subject having cell proliferative disorder, preferably cancer, is deduced based upon the methylation state or level of at least one CpG dinucleotide sequence of CDO1; APC; BMPR1A; CTAGE5; CXCL12; NCR1; NFATC2; PAX9; POU4F3; and ZBTB16, or an average, or a value reflecting an average methylation state of a plurality of CpG dinucleotide sequences of SEQ ID NO: 1-10, or preferred regions thereof according to SEQ ID NO: 11-20 wherein methylation is associated with the prognosis of a subject having cell proliferative disorder, preferably cancer. Said methylation is in particular associated with the subject's prognosis subsequent to a therapy comprising at least one anthracycline. Wherein said methylation is determined by quantitative means the cut-off point for determining said presence of methylation is preferably zero (i.e. wherein a sample displays any degree of methylation it is determined as having a methylated status at the analyzed CpG position). Nonetheless, it is foreseen that the person skilled in the art may wish to adjust said cut-off value in order to provide an assay of a particularly preferred sensitivity or specificity. Accordingly said cut-off value may be increased (thus increasing the specificity), said cut off value may be within a range selected form the group consisting of 0%-5%, 5%-10%, 10%-15%, 15%-20%, 20%-30% and 30%-50%. Particularly preferred are cut-offs that are at least 0.1%, 1%, 10%, 15%, 25%, and 30%.

Upon determination of the methylation and/or expression of the at least one gene selected from the group consisting of CDO1; APC; BMPR1A; CTAGE5; CXCL12; NCR1; NFATC2; PAX9; POU4F3; and ZBTB16 the prognosis of the subject is determined. Methylation, hyper-methylation and/or under-expression of the genes APC; BMPR1A; CDO1; CTAGE5; CXCL12; PAX9; POU4F3; and ZBTB16 indicates a negative prognosis of said subject as compared to subjects presenting zero methylation, hypo-methylation and/or over-expression. Conversely methylation, hyper-methylation and/or under-expression of the genes NCR1; NFATC2; indicates a positive prognosis of said subject as compared to subjects presenting zero methylation, hypo-methylation and/or over-expression.

As used herein the term "prognosis" shall be taken to mean an indicator of the predicted progression of the disease (including but not limited to aggressiveness and metastatic potential) and/or predicted patient survival time.

In the context of the present invention the term 'aggressiveness' is taken to mean one or more of high likelihood of relapse post surgery; below average or below median patient survival; below average or below median disease free survival; below average or below median relapse-free survival; above average tumor-related complications; fast progression of tumor or metastases.

Unless stated otherwise as used herein the term "survival" shall be taken to include all of the following: survival until mortality, also known as overall survival (wherein said mortality may be either irrespective of cause or tumor related); "recurrence-free survival" (wherein the term recurrence shall include both localized and distant recurrence); metastasis free survival; disease free survival (wherein the term disease shall include cancer and diseases associated therewith). The length of said survival may be calculated by reference to a defined start point (e.g. time of diagnosis or start of treatment) and end point (e.g. death, recurrence or metastasis).

Further Improvements

The disclosed invention provides treated nucleic acids, derived from genomic SEQ ID NO: 1-10, or preferred regions thereof according to SEQ ID NO: 11-20, wherein the treatment is suitable to convert at least one unmethylated cytosine base of the genomic DNA sequence to uracil or another base that is detectably dissimilar to cytosine in terms of hybridization. The genomic sequences in question may comprise one, or more consecutive methylated CpG positions. Said treatment preferably comprises use of a reagent selected from the group consisting of bisulfite, hydrogen sulfite, disulfite, and combinations thereof. In a preferred embodiment of the invention, the invention provides a non-naturally occurring modified nucleic acid comprising a sequence of at least 16 contiguous nucleotide bases in length of a sequence selected from the group consisting of SEQ ID NO: 21-40 and 61-80 or preferred regions thereof according to SEQ ID NO: 41-60 and 81-100. In further preferred embodiments of the invention said nucleic acid is at least 50, 100, 150, 200, 250 or 500 base pairs in length of a segment of the nucleic acid sequence disclosed in SEQ ID NO: 21-40 and 61-80 or preferred regions thereof according to SEQ ID NO: 41-60 and 81-100. Particularly preferred is a nucleic acid molecule that is identical or complementary to all or a portion of the sequences SEQ ID NO: 21-40 and 61-80 or preferred regions thereof according to SEQ ID NO: 41-60 and 81-100 but not SEQ ID NO: 1-10, or preferred regions thereof according to SEQ ID NO: 11-20 or other naturally occurring DNA.

It is preferred that said sequence comprises at least one CpG, TpA or CpA dinucleotide and sequences complementary thereto. The sequences of SEQ ID NO: 21-40 and 61-80 or preferred regions thereof according to SEQ ID NO: 41-60 and 81-100 provide non-naturally occurring modified versions of the nucleic acid according to SEQ ID NO: 1-10 or preferred regions thereof according to SEQ ID NO: 11-20, wherein the modification of each genomic sequence results in the synthesis of a nucleic acid having a sequence that is unique and distinct from said genomic sequence as follows. For each sense strand genomic DNA, e.g., SEQ ID NO: 1-10, or preferred regions thereof according to SEQ ID NO: 11-20, four converted versions are disclosed. A first version wherein "C" is converted to "T," but "CpG" remains "CpG" (i.e., corresponds to case where, for the genomic sequence, all "C" residues of CpG dinucleotide sequences are methylated and are thus not converted); a second version discloses the complement of the disclosed genomic DNA sequence (i.e. antisense strand), wherein "C" is converted to "T," but "CpG" remains "CpG" (i.e., corresponds to case where, for all "C" residues of CpG dinucleotide sequences are methylated and are thus not converted). The 'upmethylated' converted sequences of SEQ ID NO: 1-10, or preferred regions thereof according to SEQ ID NO: 11-20 correspond to SEQ ID NO: 21-40 or preferred regions thereof according to SEQ ID NO: 41-60. A third chemically converted version of each genomic sequences is provided, wherein "C" is converted to "T" for all "C" residues, including those of "CpG" dinucleotide sequences (i.e., corresponds to case where, for the genomic sequences, all "C" residues of CpG dinucleotide sequences are unmethylated); a final chemically converted version of each sequence, discloses the complement of the disclosed genomic DNA sequence (i.e. antisense strand), wherein "C" is converted to "T" for all "C" residues, including those of "CpG" dinucleotide sequences (i.e., corresponds to case where, for the complement (antisense strand) of each genomic sequence, all "C" residues of CpG dinucleotide sequences are unmethylated). The 'downmethylated' converted sequences of SEQ ID NO: 1-10, or preferred regions thereof according to SEQ ID NO: 11-20 corresponds to SEQ ID NO: 61-80 or preferred regions thereof according to SEQ ID NO: 81-100.

Significantly, heretofore, the nucleic acid sequences and molecules according SEQ ID NO: 21-40 and 61-80 or preferred regions thereof according to SEQ ID NO: 41-60 and 81-100 were not implicated in or connected with the prognosis of a subject having cell proliferative disorder, preferably cancer.

In an alternative preferred embodiment, the invention further provides oligonucleotides or oligomers suitable for use in the methods of the invention for detecting the cytosine methylation state within genomic or treated (chemically modified) DNA, according to SEQ ID NO: 1-100. Said oligonucleotide or oligomer nucleic acids provide novel prognostic and/or predictive means. Said oligonucleotide or oligomer comprising a nucleic acid sequence having a length of at least nine (9) nucleotides which is identical to, hybridizes, under moderately stringent or stringent conditions (as defined herein above), to a treated nucleic acid sequence according to SEQ ID NO: 21-40 and 61-80 or preferred regions thereof according to SEQ ID NO: 41-60 and 81-100 and/or sequences complementary thereto, or to a genomic sequence according to SEQ ID NO: 1-10, or preferred regions thereof according to SEQ ID NO: 11-20 and/or sequences complementary thereto.

Thus, the present invention includes nucleic acid molecules (e.g., oligonucleotides and peptide nucleic acid (PNA) molecules (PNA-oligomers)) that hybridize under moderately stringent and/or stringent hybridization conditions to all or a portion of the sequences SEQ ID NO: 1-100 or to the complements thereof. Particularly preferred is a nucleic acid molecule that hybridizes under moderately stringent and/or stringent hybridization conditions to all or a portion of the sequences SEQ ID NO: 21-40 and 61-80 or preferred regions thereof according to SEQ ID NO: 41-60 and 81-100 but not SEQ ID NO: 1-10, or preferred regions thereof according to SEQ ID NO: 11-20 or other human genomic DNA.

The identical or hybridizing portion of the hybridizing nucleic acids is typically at least 9, 16, 20, 25, 30 or 35 nucleotides in length. However, longer molecules have inventive utility, and are thus within the scope of the present invention.

Preferably, the hybridizing portion of the inventive hybridizing nucleic acids is at least 95%, or at least 98%, or 100% identical to the sequence, or to a portion thereof of SEQ ID NO: 1-100, or to the complements thereof.

Hybridizing nucleic acids of the type described herein can be used, for example, as a primer (e.g., a PCR primer), or a prognostic and/or predictive probe or primer. Preferably, hybridization of the oligonucleotide probe to a nucleic acid sample is performed under stringent conditions and the probe is 100% identical to the target sequence. Nucleic acid duplex or hybrid stability is expressed as the melting temperature or Tm, which is the temperature at which a probe dissociates from a target DNA. This melting temperature is used to define the required stringency conditions.

For target sequences that are related and substantially identical to the corresponding sequence of SEQ ID NO: 1-10, or preferred regions thereof according to SEQ ID NO: 11-20 (such as allelic variants and SNPs), rather than identical, it is useful to first establish the low-est temperature at which only homologous hybridization occurs with a particular concentration of salt (e.g., SSC or SSPE). Then, assuming that 1% mismatching results in a 1° C. decrease in the Tm, the temperature of the final wash in the hybridization reaction is reduced accordingly (for example, if sequences having >95% identity with the probe are sought, the final wash temperature is decreased by 5° C.). In practice, the change in Tm can be between 0.5° C. and 1.5° C. per 1% mismatch.

Examples of inventive oligonucleotides of length X (in nucleotides), as indicated by polynucleotide positions with reference to, e.g., SEQ ID NO: 1, include those corresponding to sets (sense and antisense sets) of consecutively overlapping oligonucleotides of length X, where the oligonucleotides within each consecutively overlapping set (corresponding to a given X value) are defined as the finite set of Z oligonucleotides from nucleotide positions: n to (n+(X−1)); where n=1, 2, 3, . . . (Y−(X−1)); where Y equals the length (nucleotides or base pairs) of SEQ ID NO: 1 (18012); where X equals the common length (in nucleotides) of each oligonucleotide in the set (e.g., X=20 for a set of consecutively overlapping 20-mers); and where the number (Z) of consecutively overlapping oligomers of length X for a given SEQ ID NO: 1 of length Y is equal to Y−(X−1). For example Z=18012−19=17993 for either sense or antisense sets of SEQ ID NO: 1, where X=20.

Preferably, the set is limited to those oligomers that comprise at least one CpG, TpG or CpA dinucleotide.

Examples of inventive 20-mer oligonucleotides include the following set of 17993 oligomers (and the antisense set complementary thereto), indicated by polynucleotide positions with reference to SEQ ID NO: 1:1-20, 2-21, 3-22, 4-23, 5-24, . . . and 17993-18012

Preferably, the set is limited to those oligomers that comprise at least one CpG, TpG or CpA dinucleotide.

Likewise, examples of inventive 25-mer oligonucleotides include the following set of 17988 oligomers (and the antisense set complementary thereto), indicated by polynucleotide positions with reference to SEQ ID NO: 1:1-25, 2-26, 3-27, 4-28, 5-29, . . . and 17988-18012.

Preferably, the set is limited to those oligomers that comprise at least one CpG, TpG or CpA dinucleotide.

The present invention encompasses, for each of SEQ ID NO: 1-100 (sense and antisense), multiple consecutively overlapping sets of oligonucleotides or modified oligonucleotides of length X, where, e.g., X=9, 10, 17, 20, 22, 23, 25, 27, 30 or 35 nucleotides.

The oligonucleotides or oligomers according to the present invention constitute effective tools useful to ascertain genetic and epigenetic parameters of the genomic sequence corresponding to SEQ ID NO: 1-10, or preferred regions thereof according to SEQ ID NO: 11-20. Preferred sets of such oligonucleotides or modified oligonucleotides of length X are those consecutively overlapping sets of oligomers corresponding to SEQ ID NO: 1-100 (and to the complements thereof). Preferably, said oligomers comprise at least one CpG, TpG or CpA dinucleotide.

Particularly preferred oligonucleotides or oligomers according to the present invention are those in which the cytosine of the CpG dinucleotide (or of the corresponding converted TpG or CpA dinucleotide) sequences is within the middle third of the oligonucleotide; that is, where the oligonucleotide is, for example, 13 bases in length, the CpG, TpG or CpA dinucleotide is positioned within the fifth to ninth nucleotide from the 5'-end.

The oligonucleotides of the invention can also be modified by chemically linking the oligonucleotide to one or more moieties or conjugates to enhance the activity, stability or detection of the oligonucleotide. Such moieties or conjugates include chromophores, fluorophors, lipids such as cholesterol, cholic acid, thioether, aliphatic chains, phospholipids, polyamines, polyethylene glycol (PEG), palmityl moieties, and others as disclosed in, for example, U.S. Pat. Nos. 5,514,758, 5,565,552, 5,567,810, 5,574,142, 5,585, 481, 5,587,371, 5,597,696 and 5,958,773. The probes may also exist in the form of a PNA (peptide nucleic acid) which has particularly preferred pairing properties. Thus, the oligonucleotide may include other appended groups such as peptides, and may include hybridization-triggered cleavage agents (Krol et al., *BioTechniques* 6:958-976, 1988) or intercalating agents (Zon, Pharm. Res. 5:539-549, 1988). To this end, the oligonucleotide may be conjugated to another molecule, e.g., a chromophore, fluorophor, peptide, hybridization-triggered cross-linking agent, transport agent, hybridization-triggered cleavage agent, etc.

The oligonucleotide may also comprise at least one art-recognized modified sugar and/or base moiety, or may comprise a modified backbone or non-natural internucleoside linkage. The oligonucleotides or oligomers according to particular embodiments of the present invention are typically used in 'sets,' which contain at least one oligomer for analysis of each of the CpG dinucleotides of a genomic sequence selected from the group consisting SEQ ID NO: 1-10, or preferred regions thereof according to SEQ ID NO: 11-20 and sequences complementary thereto, or to the corresponding CpG, TpG or CpA dinucleotide within a sequence of the treated nucleic acids according to SEQ ID NO: 21-40 and 61-80 or preferred regions thereof according to SEQ ID NO: 41-60 and 81-100 and sequences complementary thereto. However, it is anticipated that for economic or other factors it may be preferable to analyse a limited selection of the CpG dinucleotides within said sequences, and the content of the set of oligonucleotides is altered accordingly.

Therefore, in particular embodiments, the present invention provides a set of at least two (2) (oligonucleotides and/or PNA-oligomers) useful for detecting the cytosine methylation state in treated genomic DNA (SEQ ID NO: 21-40 and 61-80 or preferred regions thereof according to SEQ ID NO: 41-60 and 81-100), or in genomic DNA (SEQ ID NO: 1-10, or preferred regions thereof according to SEQ ID NO: 11-20 and sequences complementary thereto). These probes enable determination of the prognosis of a subject having cell proliferative disorder, preferably cancer. The set of oligomers may also be used for detecting single nucleotide polymorphisms (SNPs) in treated genomic DNA (SEQ ID NO: 21-40 and 61-80 or preferred regions thereof according to SEQ ID NO: 41-60 and 81-100), or in genomic DNA (SEQ ID NO: 1-10, or preferred regions thereof according to SEQ ID NO: 11-20 and sequences complementary thereto).

In preferred embodiments, at least one, and more preferably all members of a set of oligonucleotides is bound to a solid phase.

In further embodiments, the present invention provides a set of at least two (2) oligonucleotides that are used as 'primer' oligonucleotides for amplifying DNA sequences of one of SEQ ID NO: 1-100 and sequences complementary thereto, or segments thereof.

It is anticipated that the oligonucleotides may constitute all or part of an "array" or "DNA chip" (i.e., an arrangement of different oligonucleotides and/or PNA-oligomers bound to a solid phase). Such an array of different oligonucleotide- and/or PNA-oligomer sequences can be characterized, for example, in that it is arranged on the solid phase in the form of a rectangular or hexagonal lattice. The solid-phase surface may be composed of silicon, glass, polystyrene, aluminium, steel, iron, copper, nickel, silver, or gold. Nitrocellulose as well as plastics such as nylon, which can exist in the form of pellets or also as resin matrices, may also be used. An overview of the Prior Art in oligomer array manufacturing can be gathered from a special edition of Nature Genetics (*Nature Genetics Supplement*, Volume 21, January 1999, and from the literature cited therein). Fluorescently labelled probes are often used for the scanning of immobilized DNA arrays. The simple attachment of Cy3 and Cy5 dyes to the 5'-OH of the specific probe are particularly suitable for fluorescence labels. The detection of the fluorescence of the hybridised probes may be carried out, for example, via a confocal microscope. Cy3 and Cy5 dyes, besides many others, are commercially available.

It is also anticipated that the oligonucleotides, or particular sequences thereof, may constitute all or part of an "virtual array" wherein the oligonucleotides, or particular sequences thereof, are used, for example, as 'specifiers' as part of, or in combination with a diverse population of unique labeled probes to analyze a complex mixture of analytes. Such a method, for example is described in US 2003/0013091 (U.S. Ser. No. 09/898,743, published 16 Jan. 2003). In such methods, enough labels are generated so that each nucleic acid in the complex mixture (i.e., each analyte) can be uniquely bound by a unique label and thus detected (each label is directly counted, resulting in a digital read-out of each molecular species in the mixture).

It is particularly preferred that the oligomers according to the invention are utilised for determining the prognosis of a subject having cell proliferative disorder, preferably cancer. It is further particularly preferred that the oligomers according to the invention are utilised for determining the prognosis of said subject subsequent to a therapy comprising at least one anthracycline.

Kits

Moreover, an additional aspect of the present invention is a kit comprising: a means for determining methylation of at least one gene selected from the group consisting of CDO1; APC; BMPR1A; CTAGE5; CXCL12; NCR1; NFATC2; PAX9; POU4F3; and ZBTB16. The means for determining methylation of at least one gene selected from the group consisting of CDO1; APC; BMPR1A; CTAGE5; CXCL12; NCR1; NFATC2; PAX9; POU4F3; and ZBTB16 comprise preferably a bisulfite-containing reagent; one or a plurality of oligonucleotides consisting whose sequences in each case are identical, are complementary, or hybridise under stringent or highly stringent conditions to an at least 9 or more preferably 18 base long segment of a sequence selected from SEQ ID NO: 21-40 and 61-80 or preferred regions thereof according to SEQ ID NO: 41-60 and 81-100; and optionally instructions for carrying out and evaluating the described method of methylation analysis. In one embodiment the base sequence of said oligonucleotides comprises at least one CpG, CpA or TpG dinucleotide.

In a further embodiment, said kit may further comprise standard reagents for performing a CpG position-specific methylation analysis, wherein said analysis comprises one or more of the following techniques: MS-SNuPE, MSP, MethyLight™, HeavyMethyl, COBRA, and nucleic acid sequencing. However, a kit along the lines of the present invention can also contain only part of the aforementioned components.

In a preferred embodiment the kit may comprise additional bisulfite conversion reagents selected from the group consisting of: DNA denaturation buffer; sulfonation buffer; DNA recovery reagents or kits (e.g., precipitation, ultrafiltration, affinity column); desulfonation buffer; and DNA recovery components.

In a further alternative embodiment, the kit may contain, packaged in separate containers, a polymerase and a reaction buffer optimised for primer extension mediated by the polymerase, such as PCR. In another embodiment of the invention the kit further comprising means for obtaining and/or storing a biological sample of the subject. Preferred is a kit, which further comprises a container suitable for containing the means for determining methylation of at least one gene selected from the group consisting of CDO1; APC; BMPR1A; CTAGE5; CXCL12; NCR1; NFATC2; PAX9; POU4F3; and ZBTB16 in the biological sample of the subject, and most preferably further comprises instructions for use and interpretation of the kit results. In a preferred embodiment the kit comprises: (a) a bisulfite reagent; (b) a container suitable for containing the said bisulfite reagent and the biological sample of the subject; (c) at least one set of primer oligonucleotides containing two oligonucleotides whose sequences in each case are identical, are complementary, or hybridise under stringent or highly stringent conditions to an at least 9 or more preferably 18 base long segment of a sequence selected from SEQ ID NO: 21-40 and 61-80 or preferred regions thereof according to SEQ ID NO: 41-60 and 81-100; and optionally (d) instructions for use and interpretation of the kit results. In an alternative preferred embodiment the kit comprises: (a) a bisulfite reagent; (b) a container suitable for containing the said bisulfite reagent and the biological sample of the subject; (c) at least one oligonucleotides and/or PNA-oligomer having a length of at least 9 or 16 nucleotides which is identical to or hybridises to a pre-treated nucleic acid sequence according to one of SEQ ID NO: 21-40 and 61-80 or preferred regions thereof according to SEQ ID NO: 41-60 and 81-100 and sequences complementary thereto; and optionally (d) instructions for use and interpretation of the kit results.

In an alternative embodiment the kit comprises: (a) a bisulfite reagent; (b) a container suitable for containing the said bisulfite reagent and the biological sample of the subject; (c) at least one set of primer oligonucleotides containing two oligonucleotides whose sequences in each case are identical, are complementary, or hybridise under stringent or highly stringent conditions to an at least 9 or more preferably 18 base long segment of a sequence selected from SEQ ID NO: 21-40 and 61-80 or preferred regions thereof according to SEQ ID NO: 41-60 and 81-100; (d) at least one oligonucleotides and/or PNA-oligomer having a length of at least 9 or 16 nucleotides which is identical to or hybridises to a pre-treated nucleic acid sequence according to one of SEQ ID NO: 21-40 and 61-80 or preferred regions thereof according to SEQ ID NO: 41-60 and 81-100 and sequences complementary thereto; and optionally (e) instructions for use and interpretation of the kit results.

The kit may also contain other components such as buffers or solutions suitable for blocking, washing or coating, packaged in a separate container.

Another aspect of the invention relates to a kit for use in determining the prognosis of a subject having cell proliferative disorder, preferably cancer, said kit comprising: a means for measuring the level of transcription of at least one gene selected from the group consisting of CDO1; APC; BMPR1A; CTAGE5; CXCL12; NCR1; NFATC2; PAX9;

POU4F3; and ZBTB16 and a means for determining methylation of at least one gene selected from the group consisting of CDO1; APC; BMPR1A; CTAGE5; CXCL12; NCR1; NFATC2; PAX9; POU4F3; and ZBTB16. Said kit is particularly suited to determining prognosis of a subject subsequent to a therapy comprising at least one anthracycline.

Typical reagents (e.g., as might be found in a typical COBRA™-based kit) for COBRA™ analysis may include, but are not limited to: PCR primers for at least one gene selected from the group consisting of CDO1; APC; BMPR1A; CTAGE5; CXCL12; NCR1; NFATC2; PAX9; POU4F3; and ZBTB16 restriction enzyme and appropriate buffer; gene-hybridization oligonucleotide; control hybridization oligonucleotide; kinase labeling kit for oligonucleotide probe; and labeled nucleotides. Typical reagents (e.g., as might be found in a typical MethyLight™-based kit) for MethyLight™ analysis may include, but are not limited to: PCR primers for the bisulfite converted sequence of at least one gene selected from the group consisting of CDO1; APC; BMPR1A; CTAGE5; CXCL12; NCR1; NFATC2; PAX9; POU4F3; and ZBTB16 bisulfite specific probes (e.g. Taq-Man™ or LightCycler™); optimized PCR buffers and deoxynucleotides; and Taq polymerase.

Typical reagents (e.g., as might be found in a typical Ms-SNuPE™-based kit) for MsSNuPE™ analysis may include, but are not limited to: PCR primers for specific gene (or bisulfite treated DNA sequence or CpG island); optimized PCR buffers and deoxynucleotides; gel extraction kit; positive control primers; Ms-SNuPE™ primers for the bisulfite converted sequence of at least one gene selected from the group consisting of CDO1; APC; BMPR1A; CTAGE5; CXCL12; NCR1; NFATC2; PAX9; POU4F3; and ZBTB16 reaction buffer (for the Ms-SNuPE reaction); and labeled nucleotides.

Typical reagents (e.g., as might be found in a typical MSP-based kit) for MSP analysis may include, but are not limited to: methylated and unmethylated PCR primers for the bisulfite converted sequence of at least one gene selected from the group consisting of CDO1; APC; BMPR1A; CTAGE5; CXCL12; NCR1; NFATC2; PAX9; POU4F3; and ZBTB16, optimized PCR buffers and deoxynucleotides, and specific probes.

Moreover, an additional aspect of the present invention is an alternative kit comprising a means for determining at least one gene selected from the group consisting of CDO1; APC; BMPR1A; CTAGE5; CXCL12; NCR1; NFATC2; PAX9; POU4F3; and ZBTB16 methylation, wherein said means comprise preferably at least one methylation specific restriction enzyme; one or a plurality of primer oligonucleotides (preferably one or a plurality of primer pairs) suitable for the amplification of a sequence comprising at least one CpG dinucleotide of a sequence selected from SEQ ID NO: 1-10, or preferred regions thereof according to SEQ ID NO: 11-20; and optionally instructions for carrying out and evaluating the described method of methylation analysis. In one embodiment the base sequence of said oligonucleotides are identical, are complementary, or hybridise under stringent or highly stringent conditions to an at least 18 base long segment of a sequence selected from SEQ ID NO: 1-10, or preferred regions thereof according to SEQ ID NO: 11-20.

In a further embodiment said kit may comprise one or a plurality of oligonucleotide probes for the analysis of the digest fragments, preferably said oligonucleotides are identical, are complementary, or hybridise under stringent or highly stringent conditions to an at least 16 base long segment of a sequence selected from SEQ ID NO: 1-10, or preferred regions thereof according to SEQ ID NO: 11-20.

In a preferred embodiment the kit may comprise additional reagents selected from the group consisting: buffer (e.g. restriction enzyme, PCR, storage or washing buffers); DNA recovery reagents or kits (e.g., precipitation, ultrafiltration, affinity column) and DNA recovery components.

In a further alternative embodiment, the kit may contain, packaged in separate containers, a polymerase and a reaction buffer optimized for primer extension mediated by the polymerase, such as PCR. In another embodiment of the invention the kit further comprising means for obtaining and/or storing a biological sample of the subject. In a preferred embodiment the kit comprises: (a) a methylation sensitive restriction enzyme reagent; (b) a container suitable for containing the said reagent and the biological sample of the subject; (c) at least one set of oligonucleotides one or a plurality of nucleic acids or peptide nucleic acids which are identical, are complementary, or hybridize under stringent or highly stringent conditions to an at least 9 base long segment of a sequence selected from SEQ ID NO: 1-10, or preferred regions thereof according to SEQ ID NO: 11-20; and optionally (d) instructions for use and interpretation of the kit results.

In an alternative preferred embodiment the kit comprises: (a) a methylation sensitive restriction enzyme reagent; (b) a container suitable for containing the said reagent and the biological sample of the subject; (c) at least one set of primer oligonucleotides suitable for the amplification of a sequence comprising at least one CpG dinucleotide of a sequence selected from SEQ ID NO: 1-10, or preferred regions thereof according to SEQ ID NO: 11-20; and optionally (d) instructions for use and interpretation of the kit results.

In an alternative embodiment the kit comprises: (a) a methylation sensitive restriction enzyme reagent; (b) a container suitable for containing the said reagent and the biological sample of the subject; (c) at least one set of primer oligonucleotides suitable for the amplification of a sequence comprising at least one CpG dinucleotide of a sequence selected from SEQ ID NO: 1-10, or preferred regions thereof according to SEQ ID NO: 11-20; (d) at least one set of oligonucleotides one or a plurality of nucleic acids or peptide nucleic acids which are identical, are complementary, or hybridize under stringent or highly stringent conditions to an at least 9 base long segment of a sequence selected from SEQ ID NO: 1-10, or preferred regions thereof according to SEQ ID NO: 11-20 and optionally (e) instructions for use and interpretation of the kit results.

The kit may also contain other components such as buffers or solutions suitable for blocking, washing or coating, packaged in a separate container.

The invention further relates to a kit for use in determining the prognosis of a subject having cell proliferative disorder, preferably cancer, in a subject by means of methylation-sensitive restriction enzyme analysis. Said kit comprises a container and a DNA microarray component. Said kit is particularly suited to determining subject prognosis subsequent to a therapy comprising at least one anthracycline. Said DNA microarray component being a surface upon which a plurality of oligonucleotides are immobilized at designated positions and wherein the oligonucleotide comprises at least one CpG methylation site. At least one of said oligonucleotides is specific for at least one gene selected from the group consisting of CDO1; APC; BMPR1A; CTAGE5; CXCL12; NCR1; NFATC2; PAX9; POU4F3; and ZBTB16 and comprises a sequence of at least 15 base pairs in length but no more than 200 bp of a sequence according to one of SEQ ID NO: 1-10, or preferred regions thereof according to SEQ ID NO: 11-20. Preferably said sequence is at least 15 base pairs in length but no more than 80 bp of a sequence according to one of SEQ ID NO: 1-10, or preferred regions thereof according to SEQ ID NO: 11-20. It is further preferred that said sequence is at least 20 base pairs in length but no more than 30 bp of a sequence according to one of SEQ ID NO: 1-10, or preferred regions thereof according to SEQ ID NO: 11-20.

Said test kit preferably further comprises a restriction enzyme component comprising one or a plurality of methylation-sensitive restriction enzymes.

In a further embodiment said test kit is further characterized in that it comprises at least one methylation-specific restriction enzyme, and wherein the oligonucleotides comprise a restriction site of said at least one methylation specific restriction enzymes.

The kit may further comprise one or several of the following components, which are known in the art for DNA enrichment: a protein component, said protein binding selectively to methyllated DNA; a triplex-forming nucleic acid component, one or a plurality of linkers, optionally in a suitable solution; substances or solutions for performing a ligation e.g. ligases, buffers; substances or solutions for performing a column chromatography; substances or solutions for performing an immunology based enrichment (e.g. immunoprecipitation); substances or solutions for performing a nucleic acid amplification e.g. PCR; a dye or several dyes, if applicable with a coupling reagent, if applicable in a solution; substances or solutions for performing a hybridization; and/or substances or solutions for performing a washing step.

The described invention further provides a composition of matter useful for determining the prognosis of a subject having cell proliferative disorder, preferably cancer. Said composition of matter is particularly suited to determining said prognosis subsequent to a therapy comprising at least one anthracycline.

Said composition comprising at least one nucleic acid 18 base pairs in length of a segment of the nucleic acid sequence disclosed in SEQ ID NO: 21-40 and 61-80 or preferred regions thereof according to SEQ ID NO: 41-60 and 81-100, and one or more substances taken from the group comprising: 1-5 mM Magnesium Chloride, 100-500 µM dNTP, 0.5-5 units of taq polymerase, bovine serum albumen, an oligomer in particular an oligonucleotide or peptide nucleic acid (PNA)-oligomer, said oligomer comprising in each case at least one base sequence having a length of at least 9 nucleotides which is complementary to, or hybridizes under moderately stringent or stringent conditions to a pretreated genomic DNA according to one of the SEQ ID NO: 21-40 and 61-80 or preferred regions thereof according to SEQ ID NO: 41-60 and 81-100 and sequences complementary thereto. It is preferred that said composition of matter comprises a buffer solution appropriate for the stabilization of said nucleic acid in an aqueous solution and enabling polymerase based reactions within said solution. Suitable buffers are known in the art and commercially available.

In further preferred embodiments of the invention said at least one nucleic acid is at least 50, 100, 150, 200, 250 or 500 base pairs in length of a segment of the nucleic acid sequence disclosed in SEQ ID NO: 21-40 and 61-80 or preferred regions thereof according to SEQ ID NO: 41-60 and 81-100.

TABLE 1

Genomic sequences and treated variants thereof according to the invention.

| Gene | Genomic SEQ ID NO: | Pretreated methylated sequence (sense) SEQ ID NO: | Pretreated methylated strand (antisense) SEQ ID NO: | Pretreated unmethylated sequence (sense) SEQ ID NO: | Pretreated unmethylated sequence (antisense) SEQ ID NO: |
|---|---|---|---|---|---|
| APC | 1 | 21 | 22 | 61 | 62 |
| BMPR1A | 2 | 23 | 24 | 63 | 64 |
| CDO1 | 3 | 25 | 26 | 65 | 66 |
| CTAGE5 | 4 | 27 | 28 | 67 | 68 |
| CXCL12 | 5 | 29 | 30 | 69 | 70 |
| NCR1 | 6 | 31 | 32 | 71 | 72 |
| NFATC2 | 7 | 33 | 34 | 73 | 74 |
| PAX9 | 8 | 35 | 36 | 75 | 76 |
| POU4F3 | 9 | 37 | 38 | 77 | 78 |
| ZBTB16 | 10 | 39 | 40 | 79 | 80 |

TABLE 2

Particularly preferred regions of the sequences according to table 1.

| Gene | Genomic SEQ ID NO: | Pretreated methylated sequence (sense) SEQ ID NO: | Pretreated methylated strand (antisense) SEQ ID NO: | Pretreated unmethylated sequence (sense) SEQ ID NO: | Pretreated unmethylated sequence (antisense) SEQ ID NO: |
|---|---|---|---|---|---|
| APC | 11 | 41 | 42 | 81 | 82 |
| BMPR1A | 12 | 43 | 44 | 83 | 84 |
| CDO1 | 13 | 45 | 46 | 85 | 86 |
| CTAGE5 | 14 | 47 | 48 | 87 | 88 |
| CXCL12 | 15 | 49 | 50 | 89 | 90 |
| NCR1 | 16 | 51 | 52 | 91 | 92 |
| NFATC2 | 17 | 53 | 54 | 93 | 94 |
| PAX9 | 18 | 55 | 56 | 95 | 96 |
| POU4F3 | 19 | 57 | 58 | 97 | 98 |
| ZBTB16 | 20 | 59 | 60 | 99 | 100 |

EXAMPLE

1. Abstract

Figure 1:
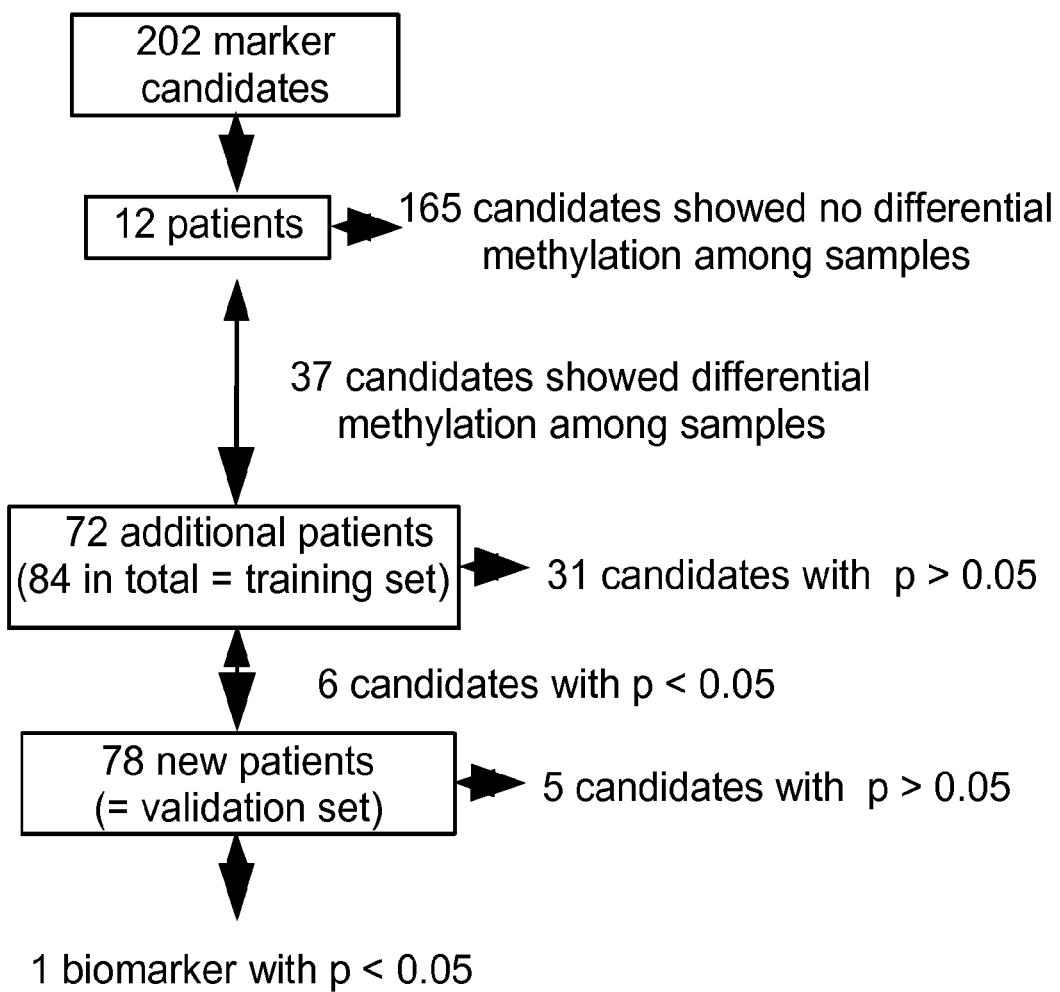
FIG. 1 shows an overview of the marker candidate selection procedure according to paragraph 3 of the example.

Various biomarkers for prediction of distant metastasis in lymph node-negative breast cancer have been described, however, there is still a great demand for predictive biomarkers for patients with lymph node-positive (LNP) disease in the context of distinct systemic therapies. DNA methylation is aberrant in breast cancer and is likely to play a major role in disease progression. In this study, the DNA methylation status of 202 candidate loci was screened to identify those loci that may predict outcome in LNP/estrogen receptor-positive (ER+) breast cancer patients with adjuvant anthracycline-based chemotherapy.

Quantitative bisulfite sequencing was used to analyze DNA methylation biomarker candidates in a retrospective cohort of 162 LNP/ER+ breast cancer patients, who received adjuvant anthracycline-based chemotherapy. First, twelve breast cancer specimens were analyzed for all 202 candidate loci to exclude genes that showed no differential methylation. To identify genes that predict distant metastasis, the remaining loci were analyzed in 84 selected cases, including the 12 initial ones. Significant loci were analyzed in the remaining 78 independent cases. Metastasis-free survival analysis was conducted by using Cox regression, time-dependent ROC analysis, and the Kaplan-Meier method. Pairwise multivariate regression analysis was performed by linear Cox Proportional Hazard models, testing the association between methylation scores and clinical parameters with respect to metastasis-free survival.

Of the 202 loci analysed, 37 showed some indication of differential DNA methylation among the initial 12 patient samples tested. Of those, 6 loci were associated with outcome in the initial cohort (n=84, log rank test, p<0.05).

Promoter DNA methylation of cysteine dioxygenase 1 (CDO1) was confirmed in univariate and in pairwise multivariate analysis adjusting for age at surgery, pathological T stage, progesterone receptor status, grade, and endocrine therapy as a strong and independent biomarker for outcome prediction in the independent validation set (log rank test p-value=0.0010).

CDO1 methylation was shown to be a strong predictor for distant metastasis in retrospective cohorts of LNP/ER+ breast cancer patients, who had received adjuvant anthracycline-based chemotherapy.

2. Introduction

Breast cancer is the most frequent cancer in women (23% of all cancers), ranking second overall when both sexes are considered together. Chemotherapy of breast cancer has progressed substantially over the past decades. Anthracyclines, introduced in the 1980s, are among the most potent agents for treatment of breast cancer and thus are components of many (neo)-adjuvant and palliative regimens, more recently often in combination with taxanes.

In node-positive breast cancer, anthracycline-based adjuvant chemotherapy has become the standard of care since the 1990s; 69% of LNP breast cancer patients remained disease-free after five years after treatment with anthracycline-based chemotherapy. Those long-term disease-free patients are supposed to have been effectively treated and any more aggressive treatment thus seems to be unnecessary. Yet, treatment with anthracyclines is linked with both, acute and long-term side effects, most notably cardiotoxicity. Therefore, if a biomarker were available to reliably identify LNP patients with a low risk of recurrence after adjuvant anthracycline-based chemotherapy, further treatment of this patient group with other potentially chemotherapy agents with differential toxicity patterns may be avoided. Predictive biomarkers for response to anthracyclines are therefore highly essential and could help individualize decisions regarding whether to incorporate anthracyclines into adjuvant therapy regimens for individual patients.

DNA methylation plays an important role in fundamental biological processes such as development and cellular differentiation. The same applies to carcinogenesis and cancer progression, suggesting that DNA methylation analysis may be a valuable source of predictive and/or prognostic biomarkers. In this study, quantitative bisulfite sequencing was used to screen 202 biomarker candidates for their prognostic impact in LNP/ER+ breast cancer patients who had received adjuvant anthracycline-based chemotherapy. The marker candidates were selected from the literature or identified by differential methylation hybridization (DMH) technology, a method for genome-wide discovery of methylation biomarkers. Promoter DNA methylation of cysteine dioxygenase 1 (CDO1) was identified as a strong predictor of distant metastasis. This finding was confirmed in an independent patient group of advanced LNP/ER+ breast cancer patients treated with adjuvant anthracycline-based chemotherapy.

3. Methods 3.1 Patients

The study cohort was comprised of 162 breast cancer patients whose tumor samples were obtained from 4 clinical centers: Erasmus Medical Center, Rotterdam, The Netherlands; Centre Rene Huguenin, St. Cloud, France; Stiftung Tumorbank Basel, Basel, Switzerland; and Department of Obstetrics and Gynecology, Technical University of Munich, Germany. Appropriate consent, according to institutional requirements, was obtained for all patients. The study protocol was approved by the local ethics committees. Patient characteristics are shown in table 3. All breast cancer patients were anthracycline-treated with estrogen receptor-positive, lymph node-positive tumors.

3.2 DNA Preparation

Snap-frozen tumor tissue or tumor cell nuclei pelleted at 100,000 g were used to obtain genomic DNA as previously described. Genomic DNA was extracted using the QIAamp DNA Mini Kit (Qiagen, Hilden, Germany), following the manufacturer's instructions (tissue protocol). The DNA concentration was quantified by UV spectrophotometry using a Nanodrop® ND-1000 spectral photometer (Nanodrop Technologies, DE, USA). Artificially methylated DNA (CpGenome™ Universal Methylated DNA, Millipore, Mass., USA) was used as completely methylated reference DNA.

3.3 Bisulfite Conversion

Two µg of extracted DNA was bisulfite converted using the EpiTect® Kit (Qiagen, Hilden, Germany) according to the manufacturer's recommendations with the exception that no carrier RNA was used. DNA concentration was quantified via UV spectrophotometry as described above.

3.4 PCR Amplification

PCR amplification was done in a 25 µl volume (1 U HotStar Taq polymerase [Qiagen, Hilden, Germany], 1×PCR buffer [Qiagen, Hilden, Germany], 0.2 mM each dNTP [Fermentas, Burlington, Canada], 0.5 µM both primers [MWG-Biotech, Ebersberg, Germany], and 20 ng template DNA). Incubation was done using the following temperature profile: 15 min/95° C. and 45 cycles with 20 s/95° C., 45 s/58° C. and 30 s/72° C. The primer sequences and the sequences of the respective target loci (prior to bisulfite conversion) are listed in table 6. Each reverse primer contained the sequence CGTCGTCG at its 5' end.

3.5. Sequencing and Raw Data Processing

Quantitative bisulfite sequencing was carried out as previously described. ABI sequencing electropherograms were converted to text files using BioEdit 6.0.7 software and imported into Microsoft Excel. The trace containing the methylation information was visualized and the normalization signal identified. The electropherograms were shifted until the normalization signal of each sample was located at the same position. The normalization signal was integrated and each data point of the electropherogram divided by this normalization value. The analyzed PCR fragments contained several CpG sites. The signals of the single CpG sites of completely methylated DNA were used to identify the CpG positions in the electropherograms of the patient samples. The maximum intensity of a specific CpG site was defined as the maximum in the region ±30 data points referred to the respective peak in the reference trace of the completely methylated DNA. The averaged intensities of all CpG sites from one PCR fragment were used as measurement (methylation score) for statistical analysis.

3.6. Statistical Analysis

Time-dependent ROC curves for censored survival data and the resulting AUC were calculated according to Heagerty et al. WinSTAT for Microsoft Excel (www.winstat.com) was used for Kaplan-Meier survival analysis and log rank test. The median methylation value in the respective patient group was used as the cut point for dichotomization.

The relation between time to distant metastasis and DNA methylation score was analyzed by a linear univariate Cox Proportional Hazard model. Likelihood ratio tests were performed to test for a significant impact of DNA methylation score for the CDO1 amplificate on clinical end points. Hazard Ratios for continuous variables were calculated. Pairwise multivariate regression analysis, testing the association between clinical end point and DNA methylation score and/or clinical parameters, was performed by employing linear Cox Proportional Hazard models.

4. Results

A recently published novel method for quantitative bisulfite sequencing [12] was used to analyze the methylation status of 202 potential DNA methylation biomarkers in tumors from 162 anthracycline-treated, estrogen receptor-positive, lymph node-positive breast cancer patients in order to evaluate their potential to predict distant metastasis. The marker candidates were taken from the literature or have previously been identified using differential methylation hybridization (DMH), a genome-wide discovery method (data not shown). A consecutive marker selection procedure as depicted in FIG. 1 was developed in order to efficiently identify DNA methylation biomarkers for outcome prediction. In a first selection step, all 202 loci were analyzed using bisulfite treated DNA from 12 randomly selected individual tumors to exclude those that showed no evidence of differential methylation among the samples. The remaining candidates were further tested for their potential ability to predict distant metastasis in a set of 72 additional patient specimens, resulting in a training group of 84 patients in total. In the final step of analysis, the significant DNA methylation biomarkers evolving from the training set were further analyzed in an independent validation set of DNA samples from 78 patients, in order to confirm and validate their true clinical potential. The characteristics of patients belonging to the training and validation sets are shown in table 3.

Figure 2:
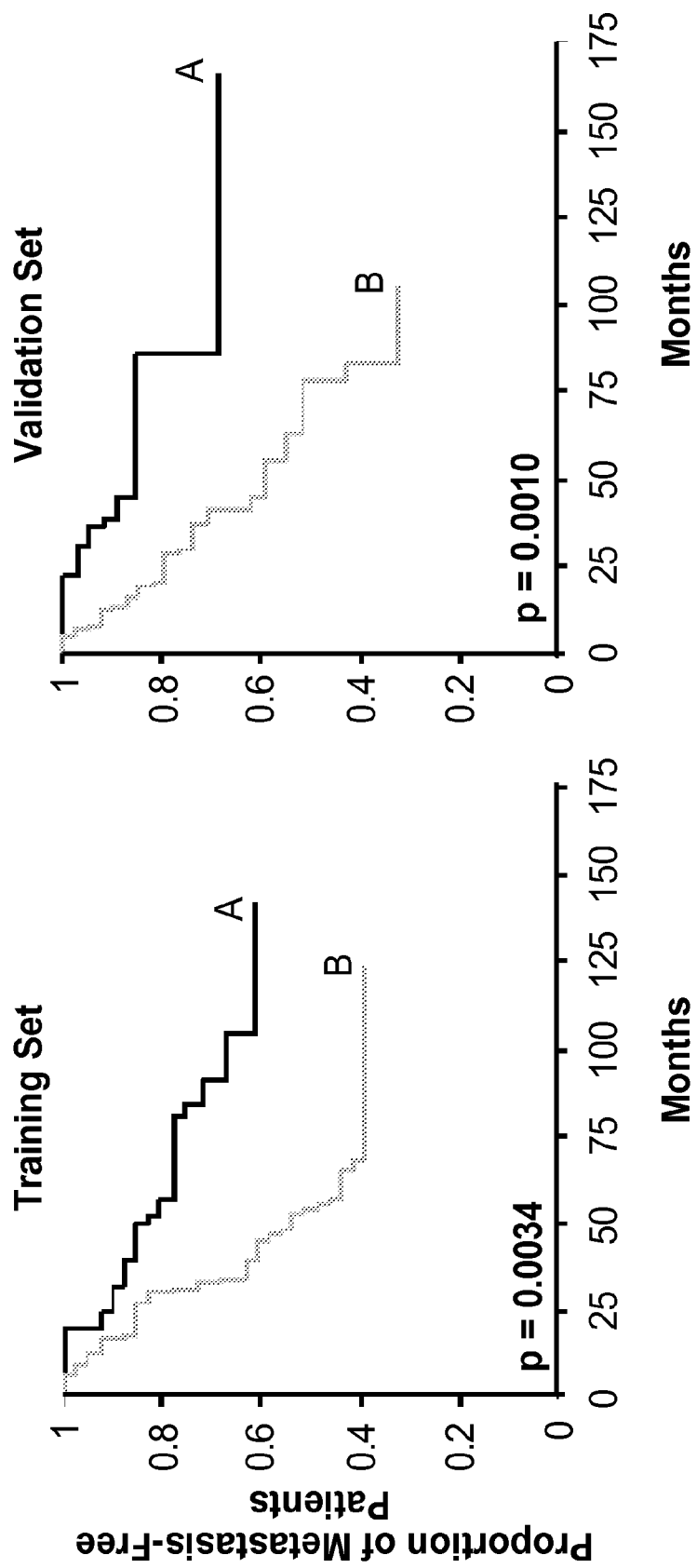
FIG. 2 shows a Kaplan-Meier analysis according to example 3. Indicated is the metastasis-free survival in the training set (84 patients) and the validation set (78 patients) of lymph node-positive patients with estrogen receptor-positive tumors, adjuvantly treated with anthracycline and stratified by the DNA methylation status of CDO1. Median CDO1 methylation of the respective population was used as the cut point according to paragraph 3.6. of the example. Curves labeled with A represent patients with hypomethylated CDO1, while curves labeled with B indicate for patients with hypermethylated CDO1.

From the initially analyzed 202 loci, 165 did not show an apparent differential DNA methylation pattern among the initial 12 samples tested, and therefore these loci were excluded from further analyses. Of the remaining 37 candidates, six loci were associated with the occurrence of distant metastasis in this training population. Time-dependent ROC analysis and Kaplan-Meier analysis was performed. In order to avoid an overly optimistic result, the median DNA methylation score of the training set was used as the cut point. The results of the DNA methylation biomarkers showing potential impact in the training set are shown in table 4. Six genes (CDO1, APC, ZBTB16, NCR1, POU4F3, and CXCL12) emerged as potential biomarkers in the training set indicated by p<0.05 and AUC >0.6. Analysis of the six genes in the validation set (table 4) confirmed the ability of the CDO1 gene to predict outcome (p=0.0010, AUC=0.69) while the predictive ability of DNA methylation of the other five genes could not be confirmed in the validation set. The Kaplan-Meier survival plots stratified by the DNA methylation status of CDO1 both in the training and validation set are depicted in FIG. 2. Evidently, DNA methylation of CDO1 is a strong biomarker to predict distant metastasis in LNP patients with ER+tumors treated with adjuvant anthracycline containing therapy. Table 5 shows the results of the univariate and the pairwise multivariate Cox Proportional Hazard models of the validation population (n=78). In univariate analysis, the DNA methylation score for CDO1 is associated with a high risk of distant recurrence in this patient group (p=0.0098, HR=3.7, 95% CI 1.4-9.8). In addition, progesterone receptor status (p=0.0190, HR=2.7, 95% CI 1.2-6.0) was significantly associated with time-to-distant metastasis in this group whereas tumor stage, endocrine treatment, tumor grade, and age at surgery were not. CDO1 DNA methylation was a significant marker in the pairwise multivariate analysis including age at surgery, pathological T stage, progesterone receptor status, tumor grade or endocrine therapy. Patients who suffered disease recurrence showed higher DNA methylation of the CDO1 locus than those surviving metastasis-free.

5. Conclusion

DNA methylation of 202 loci was analyzed in tumors from breast cancer patients who were estrogen receptor-positive, lymph node-positive, and treated with adjuvant anthracycline-based chemotherapy, in order to identify biomarkers to predict patient outcome. A stepwise biomarker selection strategy was developed which allowed for optimization of experimental efforts and costs for large scale analysis of genes. In a first selection step, a selected small number of DNA samples were analyzed in order to separate out loci which showed no evidence of differential DNA methylation. The remaining 37 loci were further analyzed in a training set in order to identify loci with a potential to predict patient outcome. Subsequently, the biomarker performance of the most promising loci was tested in another set of DNAs derived from tumor tissues of an independent group of patients. This procedure led to the identification of cysteine dioxygenase 1 (CDO1) as a strong DNA methylation biomarker for outcome prediction in the analyzed patient group.

CDO1 was identified as a candidate biomarker using the DMH method by determining its DNA methylation status in tumors from patients with metastatic breast cancer who were treated by FAC (5-fluorouracil, adriamycine, and cyclophosphamide) regimen as first-line therapy. The CDO1 gene encodes for an enzyme that converts cysteine to cysteine sulphinic acid and is the rate-limiting step in sulphate production. CDO1 is understood to be one of the key enzymes in the taurine biosynthetic pathway. Taurine inhibits apoptosis. The human CDO1 gene is located at chromosome 5q23.2 and is homologous to the rat and murine cysteine dioxigenases. Murine Cdo1 may be involved in the regulation of protein function and antioxidant defense mechanisms through its ability to oxidize cysteine residues. As has been previously assumed, the deletion or epigenetic silencing of the chromosomal region where CDO1 is located is a frequent mechanism contributing to colorectal tumorigenesis. Recently, over-expression of CDO1 was described for the Sezary syndrome, an aggressive cutaneous T-cell lymphoma.

Nonetheless, as of today, no aberrant DNA methylation of the CDO1 gene has been described in the context of breast cancer. Expression of cysteine dioxygenase was found in ductal cells of pregnant rats, but not in other mammary epithelial cells or in ductal cells of nonpregnant rats. Interestingly, repression of Cdo1 expression was identified to be associated with the malignant transition from mammary intraepithelial neoplasia to tumors in an engineered mouse-based model of ductal carcinoma in situ.

However, in the present study, DNA methylation of CDO1 was found to be a strong biomarker for prediction of distant recurrence in lymph node-positive patients with estrogen receptor-positive tumors treated with adjuvant anthracycline containing therapy.

6. Abbreviations
ROC Receiver Operating Characteristic
AUC Area under the Curve
DMH Differential Methylation Hybridization
CI Confidence Interval
HR Hazard Ratio
CDO1 Cysteine Dioxygenase 1
APC Adenomatosis Polyposis Coli
MDA Multiple Displacement Amplification
NCR1 Natural Cytotoxicity Triggering Receptor 1
POU4F3 POU Class 4 Homeobox 3
CXCL12 Chemokine (C—X—C motif) Ligand 12
ZBTB16 Zinc Finger and BTB Domain Containing 16

TABLE 3

Characteristics of the 162 estrogen receptor-positive and lymph node positive breast cancer patients treated with anthracyclines.

|  | Training Set[†] | | Validation Set | |
| --- | --- | --- | --- | --- |
|  | All | Distant Metastasis | All | Distant Metastasis |
| Total Number of Patients | 84 (100%) | 39 | 78 (100%) | 25 |
| Follow-up | | | | |
| Median follow-up [Months] | 80 | | 53.5 | |
| Range [Months] | 6-144 | | 5-166 | |
| Age at Diagnosis | | | | |
| ≤50 Years | 38 (45%) | 20 | 41 (53%) | 16 |
| >50 Years | 46 (55%) | 19 | 37 (47%) | 19 |
| Median Age (Years) | 49 | | 49 | |
| Range (Years) | 29-71 | | 33-81 | |
| T stage | | | | |
| ≤2 cm (T1) | 19 (23%) | 4 | 24 (31%) | 5 |
| >2 cm (T2 + T3) | 63 (75%) | 35 | 53 (68%) | 19 |
| Unknown | 2 (2%) | 0 | 1 (1%) | 1 |
| Tumor Grade | | | | |
| G1 | 2 (2%) | 0 | 3 (4%) | 1 |
| G2 | 24 (29%) | 11 | 30 (38%) | 7 |
| G3 | 47 (56%) | 21 | 28 (36%) | 11 |
| Unknown | 11 (13%) | 7 | 17 (22%) | 6 |
| Estrogen Receptor Status | | | | |
| Negative | 0 | 0 | 0 | 0 |
| Positive | 84 (100%) | 39 | 78 (100%) | 25 |
| Progesterone Receptor Status | | | | |
| Negative | 12 (14%) | 4 | 18 (23%) | 9 |
| Positive | 72 (86%) | 35 | 60 (77%) | 16 |
| Endocrine Treatment | | | | |
| Yes | 22 (26%) | 8 | 37 (47%) | 9 |
| No | 61 (73%) | 30 | 40 (51%) | 15 |
| Unknown | 1 (1%) | 1 | 1 (1%) | 1 |

[†]The training set was enriched for specimens that lack PITX2 methylation.

TABLE 4

Time-dependent ROC analysis of the candidate genes in the training and validation set of LNP patients with ER + tumors treated with adjuvant anthracycline containing therapy.

| Gene | Training Set (n = 84) | | Validation Set (n = 78) | |
| --- | --- | --- | --- | --- |
|  | AUC[†] | p-value[‡] | AUC[†] | p-value[‡] |
| CDO1 | 0.70 | 0.0034 | 0.69 | 0.0010 |
| APC | 0.68 | 0.0204 | 0.55 | 0.5306 |
| ZBTB16 | 0.67 | 0.0224 | 0.63 | 0.0582 |
| NCR1 | 0.63 | 0.0239 | 0.56 | 0.9048 |
| POU4F3 | 0.69 | 0.0248 | 0.69 | 0.0754 |
| CXCL12 | 0.67 | 0.0282 | 0.49 | 0.4854 |

[†]Shown are the AUC of the ROC at 48 months after surgery
[‡]The p-values are those obtained by the log rank test in Kaplan-Meier survival analysis and the genes are ranked according these p-values. The median DNA methylation score was used as the cut point.

TABLE 5

Univariate and pairwise multivariate Cox Proportional Hazards analysis for time-to-distant metastasis.

| | Number of samples | Hazard Ratio (95% CI) | p-value[‡] |
| --- | --- | --- | --- |
| Univariate Analysis[†] | | | |
| CDO1 DNA Methylation | 78 | 3.7 (1.4-9.8) | 0.0098 |
| Age at Surgery | 78 | 1.3 (0.6-2.8) | 0.5545 |
| Tumor Stage (T2, T3 vs. T1) | 78 | 2.0 (0.7-5.2) | 0.1799 |
| Progesterone Receptor Status (Positive vs. Negative) | 77 | 2.7 (1.2-6.0) | 0.0190 |
| Endocrine Treatment (No vs. Yes) | 77 | 2.0 (0.9-4.5) | 0.1115 |
| Tumor Grade (1, 2 vs. 3) | 61 | 2.0 (0.8-4.9) | 0.1397 |
| Pairwise Multivariate Analysis[†] | | | |
| CDO1 DNA Methylation | 78 | 3.9 (1.5-10.5) | 0.0072 |
| Age at Surgery | 78 | 1.5 (0.7-3.4) | 0.3160 |
| CDO1 DNA Methylation | 77 | 3.5 (1.3-9.5) | 0.0128 |
| T Stage (T2, T3 vs. T1) | 77 | 2.0 (0.7-5.3) | 0.1790 |
| CDO1 DNA Methylation | 78 | 3.5 (1.3-9.4) | 0.0123 |
| Progesterone Receptor Status (Positive vs. Negative) | 78 | 2.5 (1.1-5.7) | 0.0275 |
| CDO1 DNA Methylation | 77 | 4.6 (1.6-13.5) | 0.0055 |
| Endocrine Treatment (No vs. Yes) | 77 | 2.0 (0.9-4.7) | 0.0938 |
| CDO1 DNA Methylation | 61 | 3.1 (1.1-8.7) | 0.0318 |
| Tumor Grade (1, 2 vs. 3) | 61 | 1.7 (0.7-4.3) | 0.2506 |

[†]CDO1 DNA methylation and age at surgery were analyzed as continuous variables. T stage, endocrine treatment and progesterone receptor status were analyzed as binary variables.
[‡]p-values refer to Likelihood-ratio test.

TABLE 6

Primer sequence numbers and sequence numbers of the respective target loci (prior to bisulfite conversion).

| Gene | Primer Forward | Primer Reverse | PCR product |
| --- | --- | --- | --- |
| APC | SEQ ID NO: 101 | SEQ ID NO: 102 | SEQ ID NO: 103 |
| CDO1 | SEQ ID NO: 104 | SEQ ID NO: 105 | SEQ ID NO: 106 |
| CXCL12 | SEQ ID NO: 107 | SEQ ID NO: 108 | SEQ ID NO: 109 |
| NCR1 | SEQ ID NO: 110 | SEQ ID NO: 111 | SEQ ID NO: 112 |
| POU4F3 | SEQ ID NO: 113 | SEQ ID NO: 114 | SEQ ID NO: 115 |
| ZBTB16 | SEQ ID NO: 116 | SEQ ID NO: 117 | SEQ ID NO: 118 |

SEQUENCE LISTING (118 sequences)

SEQ ID NO: 1 - DNA, 18012 bp, Homo Sapiens
gcggtcttatagctgttttaggttttaagtagaggtcaaagtattaaaaaaaattgaagaagacatacttaaatatacaggcaagcataaaaccttgttttaaacatttaacttaaaaaaaaaaatcagaattttatccctccataggaaaggatagtttaaaatgagcatgtccaacccacagctttgaatgcggcccaacacaaattcataaactgtcttaaaacattatgagatttttttgcaattttttttttttaagctcatcagctgtcgatagtgttactgtgttttttgttgttgttgttttgagacagagtctctctctgttgctcaggctggagtgcagtgttgtgatctcagctcactgcagcctccacctcctgggttcaagcgattcccctgcctcaacctcctgagtagctgggattacaggcgcccaccaccatgcctgcctattgtttttttgtatttttagtagagacggggtttcaccatgttggccaggctgctcttgaactcctgacctcaaatgatccgcccacctcagcctcccaaagtgctgggaatacaggcgtgagccaccgtgcccgaccagtgtattttatatgtggctcaagacaattcttccagtgttgctcagggaagccaaaatattggacatccctggaaaacactgcataccttgaaattgaagttttaaccgattaggacatgttaagaatttagaaaaataaagttcttacgcacagttttttctaaatcttttgttaattgggtaaaatggttgccagaggtgattgtgttttttttttgttttgtcaacatcatagaatttataaacttttttataaagagtatgacttagttttttttttcctgcaatcatattttccagttgaaaaagcttttggccattacattcagctataaattagtaacagtgtgcatatgatttctgattatttttcctcttgagccagaactagaaactggtcctgtaatatctgtggatcttgttctaattatatatccctttttatttgaaatacttagtattttcattgcctatatggtgaattctgagttttttaacctaacacacaatattgaaatctctgccctgaaaaattcctaaacatccttgaagtctagttctgttactactttctctctgaaatcttttttgattacctagctggaaacgatctaatctcccattctttaacagtacattcccttgtattaaaacttcttctgtaaatgtcttagtcctcttctagattataaattgtcttactcattattgtatcatctacattcatacattgaacaaaaagcaccaagcactgttatagatgcgagggaaagagcagtgcaggagaatcttggttcttgtcttcatgggatttatattccactttggaaaacaatgatgagagagacagaaaattaaataaatacatagatagagcttttcagatctcaaatgcttagaatgtgaaactccatcatgtggtagaaagtgtgaggatagcaccagtgcgttgataaggtgatcatggaaggtgtgatctttgaaaatttgacatttttgccaaaacctgaatgacatgaaggactagtcatttgaagatttggaagcagaatttttgaggctgaacgaaaggtagttctaaggcataagaaagaggtaggtgaggaaggacaggagaagtgataagaatcagatctagattatgcagagttgtaaaccaaggtaaagaatttaaaatttattctgattacactgggaagccaatgaacagtttgaagtttttaagggctcatgtcattacattgggtctacccaggataatctcatgattttaaggtcagctaactaataaacttaattttatctgccaagttccttttaccatataatgtagtatattcactagagtaacaccagagggcaagtcttcagggcctaaatgctgccacattttgcatgcataagttttatttaatctaatatatatttagtatcttacaagggcagtgaaacagaactaacttagggtagctgagttgttgagtcatcacagtttttctgatttattttgcctttactaatatgcccactccttggcattacctcttatttgctaatgcccatacgataaccccaaactctgtttctctttagttatttaactaaattaacataaagatgtctcctgcatttaaagaaattttgttccagatattttccagagagatctgtattttctcatggataaaaatttatgggtggattcattgtagattctaaaaggacattttcaaatctgtttgagttttcttatttttacctattctgattataataaatccattcattcaataaatatttatcaagtacctactgctgcagagccagctactatatagtaagcatcagaatgataacagttgaacaagtaactttttatgagggatgaggcttgaaaaagtacaagctgctctgaaaggtaccttagtgaaggaaattgctgctgagacatggaggatgaggcaatatagtcagcattggctttgaaggcggactgccatttcactgttgggtgaatttggatactttttaaaatttctttgagcctcaattttccatgcatgtgaatagtgatacctttatctctatagaagttttgttagattgaatatatgaaaatgcctaacgtaatgtttgccactggtttagaagcatatttatcatgaaactgatgaagtttagtgaacctaattgcatggccctttctaaggcccttgcaggagcagccctagcaatcttgaattaatttgtgtttttcttaaggaccctcccacccagctgcccctttattataggctgctggtcaccacaaaatctgaatctgcctttggccacaggttaagtgagaaatgttaatttctctctcctctaatgttgtgacttcagttagtgtcgaacctagaagtacttaacttaaaaaaaatggaaagaaattatatatattaggttgtaggaattttataaaattcagaaaaaccgaaattcttgtaattcctagggaggaaacatgatgttttatctctctctgcttttctctgtgtacatacgcaatttattttttaaaagctagtttatatcatattaaacagacaatattctgcattttcacataatatatggattatataattatatatcatataattatattttacaacgtaattttaatcatcttataaatgtgccaaaagtataattaaccaagctgttgttagtaattgttgaggttttttctaacatttcagtagtacaagtaatgccaaattacaaatctttgtaggggtatctgtacataggataatttcttttaattgggcttgcttgagtataagaattgcctttgtccattttctgctactataacaaaatacctgagactgggtaatttataatgaacagaaatttattggttcatagttataggagctgagacgtccaagagcatggcaccagcatctggtgagggccttcttattgtgtcatcccaaggtggaaggaggaaggacaggagacggccagagcaagcaagggatcaaatttgtagcctcaggctttttaataaaacacattaatccattactgagggtggaacgtgaatacctcccattaggctgcagctcccaacactgttgcattggggattaaatttccgacacaggcttttgggggacatactcaaatcgtggtaaacattttaaagacttatatgtcctcactgaccctacaatattattttaaaatatcattgcctatttttatagtactcttgtgtttatttctatttctttgatcatttgatatactaaaacattcttctgggtttttttggttttgttttgttttgttttagacagagtcttgctctgttgcccaggctgcagtgcagtggcgtgatctctgttcactgcagcctctgcctcccgggctcaagtgattcttgtgcctcagcatcccgagtatctgggactacaggcatgtgccacctcgcctggctaagttttgtatttttagtagagacagggtttcgccatgttggccaggctggtctcaaactcctggcctcaagtgatctgcccaccttggcctcccaaagtgctggggttacaggcatgagccattgcacatgaccagaacatttttctatgtatttattagtccttcatattttttctcatgttaattgccagtacttatgcaagataccgggaaagctttttgacaggaagaagtaagtttctttctcctgtaagcaagtcctgaggctgtataacactccaaattaaaaggctatttcaaaatggtttccctactgtagtgcagtgggaacttcgagagcagaatctaaaggagtgcttggtgtttctcatccctggcagcacataccaaagcttgggcactacccacagattctttcttggtgttttaaaagctcctcggagtactaaagggattctgcagtgtaacaactaagctcagaaacttagtcccgtggctgcatcacaacatttgtttttccatatacaggggccagagttttaacttagaatattccgtttcctcagtagaaggttatattttacaataatattatttaacaattgctctactattattccgtgagggcatcttaattgaatgccctttgcgggttaatttaaaatcactttttaaaataatgtttaatgaacacctatgtagaaaacattgtgatatacaccatgagatatgagacaaaatcaggtgagggctcttcccttgggattttaatagtcaggaatgggataagaggtgtatacacacaggtacaaaatgtgtttgtgccataaaagatgtaggaacaatgaagggaaaaggagatgaattgattctaggtgggttgctggattacttcatgggaatttatgtttaagccaaaccatgatttgggccagtagagcaattaatcatcctttactttaaaaaattgtttcagtttataaagcttgttcataatacataatgatccttattacagctctgcaagataagtcagttattcccattttatagatgaaggagtagtcaagccttagaaaagttaaatgacttttccagcgttatcaagctacaaagtgaaagattcagaacttgaacctaagtcttcaatctccatatgctggagccttctaaagtatctcagtagagtagcgaagagctatatgagtaagaaactataagttttagaaagggctgatagttaattttattattaggatggaagttctgaaatagttggagataaagctatagtatggtcagcagaataatggctccctacaaatgtctgcttcctagtccccagaatctatgaatatgttaggttatgtgacaaaagggaattaaaatggctaatgaggtaactttaaaataggaagatcatcctggattattgacgtgggccaaatgtaagggtctttaaagaggttacttaagagtggaagagggaggcagaaaaatgagagtcagagaaggagatttgagaaggggcaaggtcagtcctgcagaatgagaaagactcagtccaccattgcttgctctgaagatggaagtgaagtgctatgaaccataaaatacagtggatctgtagaagccagaaaggataaggaaacagattcccccttagagcctctagaaagaagtgcagccctgcagacaccttggttttagcctagtgagacccattttagacttctgacctacaaaactgtaagttatcaaatgtgtgttttaagacactaaatttgtggtaatttgttttggcagccataggacatttaatacgcctaggaactattttattgtaggaagactaattaacatgacctcagggcactccatgactaaactccaaactgtctctgttccactgtcagcagtagaaagacatggaatgttcttgagcaaaagtgtgaagaactattttggtgtttgctgattagagaggatattggtgagaggaaaattaattaagattctattagatgctaggaacacttcttttgagactcactccttgaggtaacatagaacatactggtaagtcttgcccgtagaagactatgaatatatctcccagtcctgtgtggctgctcacgtctgtaatcacagcaccttgcgaggccaaggcaggaggatcacctgaggttaggagttcgaggttacagggagctgtgcttatgccactgcactccagcctgggtgacagagcaagacctcgtccctgaaaaaatgggagatggttaggtggatggatagacagacagacatatagataaagatagacacgtgggtcaagatctcccacttagtttatacatcactgaaaatctcattgccattgtaacatttcacctcgttctcgtatcccatgaaaaatacagaaccagttaggcacacatctaacttatctcttcttaggcttttccatcgtaccataactaactataagatccgaacactgaaaggtttctaaatctgagctttatttgatgccttagtacctgtagaagttaaatttatactagtaactgttttttcaatgcataattattattttgaaagaaaaaaaaagcttgttgatatctgtaggcataactctattctatgtctaaggtcttcggtaaagagagacgattaagtttatcagtaaagcaccagagtcaattaaggcgactgaaaggagcactaattttaattcattttacactagttaatattgtcaatattcttcttgtcagttttttaaaccaaaagtcttaaattaggccaaaagtgcctaggtaaaaatggaatggaaagggttttcttgtgtgtgtgtgtgtgtttttttttttttttgagatagagtcttgctttgtcactgaggctggagtacagtggtgtgatctcggctcactgcagcccccacctcccaggtccaagagattctcatgcctcagcctcccaagtagctggggaatgtaatatttaagacattaagaatcctattaatcctatttagtcatttttttttgtagctgcagaaggttcagaagggttttttaagttgaattatatgttcatatttacaacatttacatatgaaaccatttactaaaagcaatgaagctggttataacaaacactgatactgaaaataagagatatgtttgtcagtgcggtctttaaacagtgttacacaatttatttctgtttcattttgatcagaaaaaatatatatatcttttgagacatggtctctgttgcacaggctggagtacaatggcgagatctcggctcactgcaacctctgcctcctgggttcaagtgatcctcccacctcagcctctagagtagctaggaccacaggcgcgtgtcaccacagctggctaatttttttgtattcttggtagaaatgaggtttcgccatgttgcccatgctggtctccaactcctgagctcaagtgaactggccacctcggcctcccaaattcctgggattataggcatgagccactgcaccctgcccagaaaatatttttaatgcatacatatatatatatatatatgtatatgtagtgtaaataacatcttcaatcaaatagagatggcaggagctttattctgagctatgtgcaaacttgataagacaaggtaatgcttcagtaattttccatgctgaaatttggcccagtatactttgattatatatctatatttaattatagttttaaaatagctaagcagttttaaaaattcaaattaaacttttgtggaatctctaaaaataagaaaaatattactgagtaattggcaacataaaatacaaaatgtttaacttggctttcttttagatttgaagcatagtgactaatgaacatataatggtcgtagctttctttacaactatgtcatttaagtcactgatgaatatctatgatacatgcagtaaaaatttagacaaacattttggctacaaactggtttactaaataatagcttgtatcatagtctgagtcaagagtaataggcttacaattgtgtcttagggtactaagaagttcttttgaggaccttttaaaaggtattctttgttttgaaagactgttttccttctggaagttctaggccttatgagaaattacctattctgaatttgtcacaaaaaatgacttgtaaataagtcctgtgcagtgaatcatgtgctttcagtaagaggattttgaaagccttttgtaaaatgaagtcattctcaaaagagagttatttagaatataatcaaattgatttacatgcttttatttatttcaaatatgaagggaaattgtttctaaatatatttaaacttttaatagaacagtagtatgccatcagtgtggaaataactcacttgttaaataaatatttggggtgtatttgctgtatatcaggcattgtaacacagggactaatgaaagagaaaaaaaacaaagcacgaaaggacagcagaaatagctccataatctcactttccaggaataacctctatggacattttgttgtgtgtctattgcttttctaatatatacattttttaatcaaatggaattgcctcaaatatgctatttaatagcttgcttcttttcatactatttgaaaattaagaaacgattataatatgcttcatttaaaaactttaagtttaggccgggcacagtggctcacgcatgtaatcccagtacttggagggaccgaggtgggcggatcacaaggtcaggagattgagaccatcctggccagcatggtgaaaccccgtctctactaaaaatacaaaacttagctgggcatgatggcacgtgcctgtagtcccagctacttgggaggctgaggcaggagaatcgcttgaacccgggaggtggaggttgcagtgagcggagattgcaccactgcactcgcctggtgacagagcaagactctatctcaaaaaacaaacaaagaaaacttgaagtatagtatccttttaaattttaaatagataatagaaactggtttccccccatttaaaccagaatttaagtttaactttatatattcttgacagtttggattttgtccttcaacctcataaaattgggaatttaagcatcacctggttcgatttaaatgcaatgtagaatttgcattaaaatactacattaaagcctcagatttgtagtagctaacagcacttctatgtatgtgtcagggactgctctaaatacttcatatatattaactcctctattctgtacttctgttcccgttttatacagcaggaaattgaaacactgagaggttaagtaactaaagttacagagctagagtgacaggagtaaagcttcaactcaggcaacccagacttccagagttctgatctccactactaagctgctagcatagcttttctggtaactatttttaattcaaatataattcgagtgatctatctaacaagtcatcactctgacaactcagtgacttgtaatgtaaaattattcattgtaattcatttaatattattgtttctctgtgctgcaaaaatcatagcaatcgagatgtaatttattactctccctcccacctccggcatcttgtgctaatccttctgccctgcggacctcccccgactctttactatgcgtgtcaactgccatcaacttccttgcttgctggggactggggccgcgagggcatacccccgaggggtacggggctagggctaggcaggctgtgcggttgggcggggccctgtgccccactgcggagtgcgggtcgggaagcggagagagaagcagctgtgtaatccgctggatgcggaccagggcgctccccattcccgtcgggagcccgccgattggctgggtgtgggcgcacgtgaccgacatgtggctgtattggtgcagcccgccagggtgtcactggagacagaatggaggtgctgccggactcggaaatggggtaggtgctggagccaccatggccaggcttgctgcggggggaggggggaaggtggttttccctcgcactgtcttaaaccgatggcctttccttggcacagggtccactgcagcatgccaaacgaggaggcaggggcgtcgtccccccgccccccactgcagcactggagatggatttcctgtacttcggatccagggtttttgacagaagaggaagaagggggaggggtagaagtgttaaggggagtctgctgagaaaagctgtttttgaagccagaaggggtttttgtttttataatgccatttgacagagtggaataacagtatctaaggaaacgggtagaggacaacaaagaatggagcatattcatggcgaggagcaaaagctctaccccattgaaaggcttcttttcctccctggcgacaaggacacatgcattggtggccaaaagagagaggagacaaaaccgctgcagatggctgatgtgaatctagtggaaagagctactggggatgagagaaagaggaggaggcaggtactgcagagcgtgagtggtggtgttggttggtgaaatactggtcaccagtagtgtgcctgcttttgtaaaacatctaagtaaactccctgtgaacagggtggcaaacagataccagtgtctttgttagttacaaaatgcagtggtagtggctttttgcggacgactgcagcagtgctttttctccctctgttaggccgaaaagacaactgcagaggaataagaaaccttgcagcaaatgctggggtagaagcccatttacaagaagccatagtttataaatgcagcctgaacagcagaaaaaaaattactgttttttaaagtaggaataatgtcaggctatgaatgttttgtcattggaatgtattggacactttgattctacatcacgaaagtgatgctcaaattctttgatttaacataaatcctatacgaaatcttaataaattatgtatgaaacagtggatcttttcttttgttagtgaagcttttatgccattaattaggtcattcaagagcaaaccactttacaacgtaaattactttgtcaaaaattatggtgaacaaatttttgtaggcctaatatttaagacctatagttaagtaattttatatttctctttggttgcttttagataacactgaataaatatttaagatattaattcagtgtgcaaatattttaaattaaagcaacatggcttttcttctagatgtatttctgtttagtgagtactcatgagatatactcttgatataaagtgtttttcattgagcttttttttcctttacctaaatgtaaaagcctatctttatgcatacttatagtagccagcctgccacacctccccactccctgaacaaggatggcagtggctttgtaaagccctccagggtcagtgacagtgtctcttaaataatgtttatgtaatagaaagtcttaagatgacctattatattgtttcagtaatattttcaagataatgcggaattgggctggcttagataaataagactacataagtttttcactgataaatttaaatagttctttaaaaaattatttctgctttaagaattacttgatcatggatatcagggttaatagtacttaggagccgggcgtggtggcccatgcctgtaatacaagctaaacaggaggctgagggaagctgaggcaggaggatcacttgagccttggcgttcaagaccagcctgggcaaccaagcaagaccctatctcaaaaaaaagtacttagagtctcttttttaaaatctgatggaaactatggctagaactaaagatgtcacattaaaattccaaatgacatttaacagctaatattactcagttctttgaattccattagcatagtgtttgagagtctataaaactattatttttacataaattaccttttaccattttaacagctcattgtagcattatttttattttaaatgttagagactcctattcaagtatgttgtgactttatccaaggtcaaatattgtataacaatgtaaagaacttaagtcttctattttattctaattctataaaactataatgccttttattacatacatacaaaataatatataacagaggtaatttgaaaaacagtgtaagtcactgacaaattattcaaaaaatgaaaaggcaatcctacttggttgtggatttttatctacaatataagaatgctttaaaaaatacctggtgactaagcaaatggagaagcagcagttttcataatgacattcataaacgactttttaaagatcgtcttattaatcatatgaacacatttaagtagaacagtgttagattgagatgtttttctgaattaaataagaaataaagaactaaagtttatttcattcctcttgtagtatatctaatctatgactgacctattggctttagtggtctttgaaattattcactgctctgatatggcctgaattgtgctgtttaaggaatttaaaattaaatattcataaatgttttatgaactgaatttaagctattgaagtttttgttttttgtgtttttttttctttttttttttttttttttgagacagggtctcactttgtcaacccaggctggcgtgcagtagcaaacatggctcacttgcagcttcaacctcgcaggctcaagtgatgctcccacttcagccctccaggtagcagggactacaggcacataccaccgtgcacagctaatttttatattttttgtagagatggggtttcaccatgttgcccagggtggtctcgaactcgtgagctcaaatgatcctcccacctcagcctcccaaagtgctgggatttacaggtgtgagccaccatgaagtttttccatttgcattaattgctctgtagattttaccatttttgtctgttttataaactgttactcattttatgaaatttaaccaatcttttatacttgtatatgtttaaatgatcttttatacttgtatatgtttaaatgttctcttcaattttgatctcccttctcccccttttcttgtattagaatctgaaacctacctatgcagcacataaaatgggatagagtattatggttcagaaaagatgggtaatagtttaggaaatatattcactacatatttattaggataccttctaaatatcatctttgaaaaatgctggagtcaaataagacacgtaaactaatctctaagaaaactcatggtagaattatgtgaaatttcattacaagttaaacactgctttggctactcctaggatatttaaagatttatataatctaagatatcctctaatttagaagaatatggtggattgctgtttgaaacactgctttttcataaaatctgcttagagtcacagagaatttttgaaaactaaattacttttgaagtactaagtatcttgaatgtacaatgagaacattaggtgaataggtatgttctcaaaagttgactttgtaaatcaaatcatacatcatcagttgatacaaggtaagccttctcccctttattctcacaccctgcacccactcttcttgtgtgtttaatatgcataaattcttgagaaatagcatcattttgtgagtctgttttttacagttaatgagatttttaaaaaaattttattgtgataaatatacataaaatttaccatcttaagcacttttaattgtacagttctgtggcattaagttcattcacattgttgtgcaaccatcaccaccacccatctctagaaatttttaatcttccctaattaaaactctgtgcacattaaacactaacatgccattttcccctccccccaacccttggcaaccaccactccactttttgtctcaaagaatttgactattctgggaacctctaataagaaaaaccatttaatatttattcttttgcacctggcttatttcacttagcataatgtctcgaaggttcatccatactgtagccatgtgtcagaatttctttcctttttaggtctaaatgatgttccattgcatgtatatgccacattttgttcattcatctgtcagtggacacttcaggttgtttccaccttttgtctatcatgaataatgctactatgaacgtgggtgtgcaagtgtctgcttgggttttactttttttgtgtgtactcaaacctgtgtttttaatttacataatttttgaacattattaactcaatactgtttttaagatctatccattttactttatgtccatctagtttgtgatgctaactctgctctatagtattctatagtacctatcactgttcctccagtgaaggccgtaagttttctccaaatcccgttaaccacaaacacctttatgatatacattcttatacatatctccttggactatgttatttatgtatttctgtataacaaattgtaccaaaacttagtggcttaaacagtttctgtggggcaagaattcaggaatgtcttagttggatggtctgactgaggcaggatctcttatgaagtagcagtcacgatgtcagtcacagatacagtcatctgaagggcttgactagactgacggatcttcttccaagatggctaactcacatagtctcagtttttcattggctattggcaagagacctcagttccttgtcacgtgggcctctccatggggctgcttgaatgtcttcatgacatagcagctggcttccctcaatgattctaacagaaaggccatttatgacctagactcagaagccacacaccattgcttctgctgtattctctttattagatatgagtcactaagtccagcccaccaaagagaggaattaggatccacctcttaaaggagtagggtcaaagaatttatgatatattttaagatcattacatcgaccagtgaaacagtttcactggatttatccctaggagagggatcactggataataagggcattgtttcctattgctgttgtaacaaattaacacaaacttagtggtttaagagaacacaaatgtattatcttgcagtcctggagatcagacacggttttcactggaccaaaatcaagatatcagtggctctgcgtctcctctagagattctattgaagaatccattttcttgcttttcttcagcttcttgcattccttgtctcatggcctctttctccatcttcagtgccagcagcattctaaatctctctctgaatctgaccctctgctgctcttgtcacatattcttctctgacccttctgcctccttcttaaaagaacctttgtgattacattgggtccacccagataatccaggaaaatcagcttcaagatctttaacttaatcacatctgcaaagttcctttagccacataaggtaacacattcataagttttggggactaggatttggccatctttgtggggccatacacaggcatactcatctggttctccattttttttaagctgaaggatttttttagttatttttacttttgcgaatgtgtgttactttcttttggtaatttcagattttcatttaccaagtttatttaaagcatagtataatatataatgatcaccaagatggtaagcagatattcattgttcaattagattcttgattttatcatcacttaatttatatcagtgtatcagctacttctgacatagtctgtaatagaaactgagaaacgttaaagcaacacagccttattaaatttctctttgtatcttttagactcgttataacaccagttctgtgggcgctttgttgaaacttgatctgtcattgtcttaccagtcattgaacttagggccactctaatccagtatgacctcatctcaaacttgatccatttatgaagactctgtcctcaaataaggtcacatttgacatgacattttttggtgtttttttgtttgttggtttttttccctctgttgcgcaggctagagtagcttctgggctcaagcagtcctcccaactgagcctcccaagtagctaggattacaaacatgtgccaccacagctgactaatttttaatttttttttcataaggagagagtctcactatattgcacaggctggtctcgaactcctgtctacaagtgatcctcccacctcagcctcccagagtgctgggattacaggtgtgagccactgtgctcacacctgtaacatatctttttatgaaacacagttcaacccataacactcccttaatacttggtaccttgtgaataataagatacctaaatatggtaccttgtggataacaaggcatattgtcttactttttttatggaaaagtcatcttggacattctctgaacttgtgccctctctttctgttgtctgccctctgtggctgataatgcaccctttctgttcattcttacgtgtatatttgtcttttatatggctgtcgctgagtaaagcattttgggaattacaaaagctaagtattagatatagaccttgtcttcaagatatttatgctccagctgggaagacaaaacaccccaaggtaaaatggaataatttgagaagttaggccaaattgtatagtatttactgttcagccagcaggaagattcattattggctagagacatcaggaaggttttgtgtaagaaactgagctgggccttaaaggatgaggatatattataacagcagaggaaaaaaggatgtggtattcagaaaggggaggaggtataaacaaaaatataaaggtaagaaatagtttgtagaggaaagtgaggagagacttacttgaggaaggttatcttggaacttaataggaaataagttttgaaggtagactattatcagatataatagattgtgaacaccagacagaagttatacagtctttgagagcatgagcattaaaaacaagtacagatttgaattctggcataggctcttgatatgtgttcttagggaagttatctactgttttggagttccatttttcttaactcaaaaatgagtaacacctacctcataggtggttgtgaggattaaatgagttaatatatagaaagcatttacattacgtgagatattgtaagtactaaatagatatcaggctttctgaatttcacatatcaaatacataaaaaataagggcatatataggatttaaataatatgctggtcagttatagaactttatatacttttccttttaaaacatttttagtaaaatttttatgaaaattagtcaaggcaaacctttaaaaattttcagatggtaacaattttataagcaatagtcttccattaatctaataagcaatgtatcaatgacaataaaaagatgactcaaaaagccttatatacctaacaattgagacagatctttgaagtatcccctagatcaaagaggaaatcaagatggaagtcatgagttatctggaaataaagaggggaacacttcatactaaaacttgtggaatgtagataaggctgtactaagagaaaaattgatgtccttaaaatttatattattaaggatgaaacgaataagtgaatgtttaagtaaagtaaggaaataaatgaattaatattcactttattattattattattattattattattttttgagacggagtctcactctgtcgccgaggctggagtgcagtgttgcaatctcggctcacagcaacctccacctcaagcgattctcctgtcttagcgacccccccaccccacaccatagctgggactacaggcgggtgccaccacgcccagctaatttttgtattgttagtagagacaggatttcaccatgttggccaggctggtctcaaactcctgaccttgacctgcctcgcaaagtatggggattacacgcgtgagccaccacgc

SEQ ID NO: 2 - DNA, 30714 bp, Homo Sapiens
cggtgtctggatctgtcgcccaggctggagtgcagtggcgtgctctcagctcactgcaacctccacctcccgggttcaagcgattctcctgcctcagcctcccaagtagctgggactacaggcacccgccaccacgcctggctaatttttttgtatttttagtagagaaagggtttcaccgtgttagccaggatggtctcaatctcctgacctcgtgatccgcccgccttggcctcccaaagtgctgggattacaggcgtgagccacctcgcccggcctgctctataaccttttgtactccacattcagtgttaggtgcctcggtttgagaagccgaaggccagataagtgctacaggacagctcagcaggccgctaacccggcctgggagtgggccgccaaggttttctagagaaggaaattccagagctaaggctggaatgaagaactggagcccagcccaagctgaagcagaactcatatactaattactgaactgcattgggctgtatttgaagtaaggctcatttagagttttacagtttgttttctctccccttcaacacaaacactaatggaccaatcactttctagaaggaaaaagaaagtaactaaaattcattgagtgctgactctatggcaatcactttgcatatatctcagttaattctgacatctgtcccatgagattggtattatttattcccattttatagatgaagaaactgggagtctaagaggctgacaaactctgcccaaggtaaaaaactgggaagtacagccaggattctgattgcaaagttcgtgttcttcccaccacatcatgtggctaagcctgtttctcaagagtctctttagtggatatgcagaagcagttaagaaaatagtgggattggcctcaagtttcaaggaagaaaaaactctttggccatctcttttggtcaaagaaagttctggaaaggggtttctgggctactcctctggctggcattgcagcgccctacctcaccaagccagctctgctgaatctggacttggggaagtgagagttcacaggacatcctctgggagtgtccgctgaggtctgctttatacagtttatactttgctgtaaacagctcgctgttcccaattaaacctgtacgatcatgtgtgaacttttaggaaatgaggacttctttttatggttctcttctcagtgttaaaaccagagcccttgtcagtccacgagcctccttaaactgttgggccttgactctgagactccggaatgtagtccagaaatgcttggatcctggcacaacacccagggaatgcctaagtgagaggatggctccaggtctgcagccatgtcttccagaaggatgttctctgattcttctcagcagggttctagggcatcccaaacacaggtctctgatgctattcacgctaggatagggaatacagatctctcaactaaaattgctgcctgaagtaatttttgaagaaacagtatttcaaaatgactaccctctctcttagagaaagagttggttgaaaccactttaatttgaaattgggtaataaagaaatgaatgggtttagctctctttaatgttgacaaattaagaaaggaatatgtgcttattaaataaaatatgaaaaacacacataggcagaaagaagaaaaaaaagtgaccatagtcctactactgggagacaaccgctacttagcattttggctagtttctaccattaaaaaaattgttttttttgtttttgtttttgtttttttttgagagggagtctcgctctgtcgcccaggctggagtgcagtggtgcagtcttggctcactgcaacctctgcctcccaggttcaagcaattctcctgcctcccgagtagctgggactgcaggtgcatgccaccatgcccagctaatttttatatttttagtagagagggggttgcaccatgttggccaggatggtctcgatctcctgacctcgtgatccacctgcctcggcctcccaaagtgctgggattacaggcgtgaggcaccatgcccagacaaaaaatttgtttttttaaaagaatcggccggatgcagtggctcacgtctgtaatctcagtactttgggaggctgagacaggtggatcacctgagatcaggagtcgagaccagcctggccaacatggcgaaaccccatctctactaaaaatacaaaattagctgggcgtggtggtgtgtgcctataatccttgctactcgggaggctgaggcaggagaatcgcttgaaccctggagacagaggttgcagtgagccaaggtcgggacactgcactccagcctgggtgacagtgagactccatctcaaaaaacaaacaaaaaaatcgtagtaagaacacttaatataaacggcaactttatatccattgaatagcaaccccgatttctggtgctctgcatgtttagagaaacttctctagtagcaaactacagaaaagatccctgaatgtgtgggctttctaccatttatttttaacagcgagaacaaaggcatcaattcagccaatggtttcagaacctgttcttcttttttttttttctcactccatcatccagactggagtgcagtggtgccaacatggctcactgcagcctccacctctctggctccagcgatcctcccacctcagcctcctcagtagttgggactacaggtgtgtgccaccatgcctggctaatttttagtattttttgtagagaaggggtccgcctatgttgcgcaggcttgtctcaaactcctgggctcaagcaatcctccctccttagcctcctgaatagctgggactacaggtgtgtgccaccatgcccagctaatttttggtattttttgtaaagaaggggtctccctatgtcacctaggctggtctcaaactcctggctcaagcaatccgcctgccttagcttcccaaaatgctgggattacaggtgtgagccaccatgcccagcccattttcttttttaaggtggcattttttttagttttaatttttgtggatatatatatatatatattttaaatggggtacatattttgatacaggcatgcagttataataatcacatcacggaagctgggatatccaccccacaagcatttatcctttgtgttacaaacaatccaattctactcttttggttgtttagatgcttcattttctttgttcctttttttttttttgagacagaatctcactctgttgcccaggctggagtgcagtggcgcgatcttggctcactgcaacctctgcctcctgggttcaagagattctcttgcctcagcctctcaagtagctgggattacaggcgtgcgtcaccatgcccagccaatttttatatttttagtagagacggggtttcaccatgtcggccaggttggtcttgaactcctgacctcaggtgatctgcccaccttggcctcccaaagcgttgggattacaggcgtgagccactgcacttagctgagatgctgcattttcaatgccaacccctcaatccctgcccattgtgtgcactgagaccatcaagtgatttttttatatatccttcatgtagacctgcactggctagtacatacaatagctgcttggcatgtgtgactgtgtaaattctaaattagttaaaaataaataaaaatcaaaattcagtttctctgtttagccatatcaaatgctcaataaccacatgagattaggggctactgtgttggaacagggaagatacaggacattttcattttcactgaaagttctattagacagtgctggtgtagattctgacctgctcagctcagccttaagaacaaagtcttgagcctagcacggtggctcacgcctgtaatcccagcattttgggaggctgaggtgggaggatcacttaaacccaggattcgagatcagactgggcaatacagggaggccctgtctctacaaaaatacaaaaaaatcagctgaatgtggcagtatgcacctgtagtcccagctacctgggagactgaggtgggaggattgcttgagcccaggaggttgaggctgcagtgagctgtgatcacaccactgcactccagcctgggtgacagacagcaagactctgtctttaaaaaaaaaaaaaaaaaaaaaaaaaaaaaaaaaaaaaaaagatagcattttttacctcaaataatgacagaacgcagaatatttctcagcaataagaaaagccaccccaagaagcagcaaagagatgggctcacagtctctgaaaaggaagtcagtcattagccaccttctgacatcctagcaattagctggtcttgggagaagagcaggtatctccagagaggtgccaaataaataggataagagactataaaaatgaaaagccttttggcctttcatcacaggataatccaatgcatgcgaattaatggtgaaaggctcagtaatagcctttgtgaggaaataggagcagtgtagcaggatatcctttttccgcactaaagcacccaattctttcaattttatatacagcggaagcaattaattgtactagaaagaaatccacagctggcttttcctgatggcctcataagcaacaagcactattgttcagtttccgggacagatgtaaagtcattctattgcactgctgagatttttctgaatgtttagtttgacttctccaaagataacttatgtgttaacatctaaaatttgattcgtcttgtcatcacacattttcagtataagcaactgtcaaaaagttaatttttattgtgctattgcactccagcctgggcaacaagagtgaaactccatctcaaaaaaaaaaaaaaagttaatttttgatttgtaatataatccagcacgtgacttgatgctggtattttttccaaacgttatgtgactgaatcatgttattcacttttgtttgttttacatgtttacatgcagttgaactgcactgcctctgcttttgtggtatcatccacagtgtggctattcaggaatcaggcataacaagattatacatcaaaaactcagaaatttaacatttcaaatgctggcctgtatggcattgcttcaccttctagatgcattaaaatacaccatatttcattaattctcagatgcacattttttttgacatttgaaactttctggaattgcgatatcttaattaacgtgtcagggtttaactggcaaggtttttcttccttagttgtacataaaataatgatggatcttataatcaacagtatccatgctgttctttgggtggaaaaaacccacaacgaaacagtaccctagttttgatgacatatggtatacatagttaaaatctcatgagtatgatgtgttattgcaagtgtaacaacagaacaactctttatttattttttctgagacatggtctccctctgttgcccaggttggagtgcagtggcatgatcacagctcactgcaacctctgccttctgggcttaaggggtcctcttgcctcagcctcccgagtagctgggatgacaggcaagtgctaccatgcctggctaatttttgtaatttttatagagatggggttttgccatgttgccccggctggtctggaactcctggactcaagcgatctgcctgccttggcctcccaaagtgctaggattacaggggtgagccactgtgcctggcctagaataactctttttaccaagaaaaatattcacgtcaatcaaataaataaaaactttaattacatatcttatatgggattctaactgacttcattctgacaaatatacaatttgccactttcatttttctctctatcaatcaaccagttcttttaaataatatctactcttttttttttttggtgctgaaacccacagtcgaaaatatctacttttctgattataaaagtaacattgggccgggtacagtggctcacgcctgtaatctcagcactttgagaggccaaggcgggcggatcatgaggtcaggagttcaagatcagcctggccaacatggtgaaaccccgtctctactaaaaatacaaaaattagctgggtgtggtggcgcacacctgtagtcccagctactcaggaggctgaggcaggagaatcacttgaactcgggaggcagaggttgcagtgagccaagatcatatcattgcactccagcctgggcgacagagcagactctcaaaaaaaaaaaaaaaaaaaaaaaagtaacgtataacattgtccattgtgggggagataaagcttatggaagaaaataataaccatccattaggccaccacagaacactgccaacgttttctctttatttcaggataatctatttctttataaacacacatatttaataatacaaaattaacaaatgcttaaatatatcttgtcaaatgtcctgaaaggtatataatgttacacaataaaaaagcgggttctttaagcaagccagggaccagcctccccattgccactggagtagaattttctggtgttcgacaggatcacgtgcagatgttgcaatgcataattccagggagcaccattcgtgtcaggcaggttgcgaatggcacccccttaaagttgtgcaacctagcaaccctggtgctcagtaccgtgaccatagcgacagtggtacatacgcaggggagatagacaggagggaggatgcaacagcacagcagatgcatcaaggagtttgcaactacccaccaaccttcaaaacaatggattcgcagaagcaaggattcaataactggtaagctccagtggcctgggactgcttttttgatactacgtgtattttggtactccctaaactgtctccctcaggctgagaggcccctatttatgttgaagaacaaaggtatgaaaacttatttgtgagaaagacataagaacagctaagctatgtggaaagtcagtgatgtagaccattgagagaaaagcctaaggagatgaggatggagtagtcaaagatgacttcttggaagaggtggtactcaggcagtatagggaggagaatggcattaaatggagaatgaatatggtccattcttcagaaagtagtgagaccagtctaacgaaatgttactctatagcagtgttttcagatttaatgggactggtgtttcacaatagaaatctaaacaactgggcaacattagttgaaagagggaatgaccaattaggaggagagctagcagcattcaggatcggaggaagaggggctttaaggtaggtagcaaactaaatggaaactaatctgcattttaaaataaacactgacaagtattggttactggttatatatatgactatgtatgcctttgaaataataaaggaagttgttttaaagtttatttattgagaacaagttgttagatgatagttctgttattatgatgtacaggatttgttagtagactctcattccaacaagataagtgctttatcattaatcctcaaaaatatggaaaaacaaaacaaaacaaaacacctaaccctgccttggctaatagaaataaaaagaaatgcgccagggcaaactaccagtagagaacaaaattaagtatgtcattcatttaataaatacttactgactacctactggtgtgccaagcagcacactggatacaatggagtgagaatgagacagttcccattctctgaacttttgagtccagcacagggtcaggtactttcaacatatccgatgggtaaactagtatgcctggtcacactggtgacaccacaccacatctaggaatacatcccaattaccatgtaagccatggacagtaggcacagtatggtgttcatgaatctgcactcctgatccagattttatctccccagttatctcagcttgaatcttttatcatcgcaccttgccttccttttactagtcattcccaaggtaatcatattcagctccacatgctggatttctggactactagctccaaaggaattcttgagtagaatcagtgtttagggatactaagaagaatcagacatgggtcttttcatttttgaatgtatgtatgggttttttgtgtgtatacacacaaacatatgtacatgcatacgtacatatatgtacatatgtgtacatgcatacttacatatgcacacatatgcacgcatacacatgtgcacatatgcgtgcgcacatgcacatgtgcgcacatacgcatatatgcacgtgtgcacatacgcatatgcgcacgtgtgcgcacatacgcatatgcgcacatatgtgtgcacacatacgcatatgcgcacatatgtgtgcacacatacgcatatgcgcacatatgtgtgcacacatatgcatatttgtgtgtacatatatacatatatgcatatacttacatatgtacacaaacacctacacacacacacaaagttcagactagaaatctatttgaattatattcaatagattatatacacacacacccctattacacttggattaatttttagccagaaaaaaatatatatatagcttttttttttttgaaacagagtgtcgctctgttgcccgggctggagtgcaatggcgagatctgggctcactgcgacaagcgattctcctgcctcagcctcccaagtagctgggactacaggtgcctgctgccacatccagctaatttttgtatttttagtagacacagggtttcaccatgttggccaggctggtcttgaactcctgacctcaaatgatccacccaccttggcctcccaaagtgcttgggattactagcataagccaccacgcccagccaaaattacatataatacacctttaatatgtacttagtgtatgtccagagcatatatattatatatagttttcatctggttaaaaaataatccaagtgcaataaaccaggtgctgtgaggatagggaaaagcagggcagtgagctgcagcaggacagggaaggccaagatctactgtgggctgcgtgggagttggggtagggaggccccagctcccggtgctcggtgggaggaaccatagtcctctaggcagtgcctgatagccagagagtagtgagcaaacaacaggtggtagtccaggagcgcagtggggatggggacatccagcctgaggtaatgggggaagggaggcccaacagatagatagaatacagatacagggagcctagaaacaaagagctggaggcaattaagtgatgccaccaacaatacctacaactgcccagcagtctgggtgcagggatgcagctaagtccaaacaacaagcagagaaattccaggtcctggcaagctaacaggtcagggtttcagacacaagagaagggctgtcagttcttagaaaggggcgaggcagtgggaggctgagtcttgagcttgggaccaaagctctgataattcttcctgcctcaaggcctaggaaagatcaggttctatggtaaagggtgtacggatagtagggaaaggaggaatacagaggccacggactaggtaggaccaagtgagagcagcaatatcctccatcatctatctttcaatcatagtagccagtgctttgaggcaaagataaattaaaatggagctaagggagaaggagcaagttgtttagaagtaaacaaaagaagtaaaacactgtaccaccacaatgaaaatgaattcaggtttttaaacttcctctattttgtgcactgaattatatacatccatcttattcttaaccacagtttctgtttcagtttagtccttctaagccatgatggggtactactaaccaaaaaaaaaaaaaaaaaaaaaaaagatgtagtagtgtccatgctgaaaaatgaagctgtttattctccctaacacctacccatttaatattgggtttgaagccaacctaaagggtcaccctaccaatggcattccttcactcgtgcctccttactggcctctaacttatcatcagacccagagacttcgtgctgccttttgccttataagatctttacaacatgaaaatgactttgaatggattagcttggattaatctattcaccttggatccctgaaggcagaagtcccatttcactgaagaggatgtgatccacagctttcccagccaaccttcactctttccaagatagccatgccaccctctaacactaaaagggtcttggtgacaaggtttagaaatgcctagaggatatgtatgcttatttctcttctctcatttaacaaatattcacttgccaggcactaggctctgaggagagagttgagaatagattgacaaagtcaagctggcctgtagtcccagctacttgggcggctgaggggggaggatcacgtgagcccaggagttccaggttacagtgaactatgactatgccgctgcactccagcctgggtgacaaagtgagaacctgtctctaaaaaaagagagactgacaaagtcttttgctcatggagtttatattctagtggagcagaggggctcagaccacaaacaaataactaaatgcacgatgtaattaatgaatgctgctttgggcatgtaacaactacctctcttgtgacctacctggacagaagaaaagaccatttccagcctattctagtaacccacttaaaggaataccaacacattacggaatgttaactgtggatcccgagatgttgcttttgagtttgggggccagaacacacgtgtccagatgtctccctgggcagacagaccggagaaacgggctggcatgcataaacatgccagtagccagggagaacagcatgccccactagctgctggtagccagggcgctgaggattgaagcctgggtactagctgggccttatcaaaggagagcgaaaaattcctgaagatttgaaaaggagagtcttttgcagagaagcaaacatatcacgacttaaaatttgatgcttcaattttgctctcatttctacagtggcagataacacaagccagggaatactcatttgtacatttcagaaacttgatgtactaaggttcccacctgagattgttgtctattttatagaccaattcatatgtctaaaaatccaactagactataaagagcataataacacgcttgccatggttttctctgccgacacattgctcagcatacgtcaatgagagctttgaccaatcaatgtgaatctccttaagcaaaaggcccatcttttcctttagaactaaagctggggctgggcgcagtggctcacgcttgtaatcccagcactttgggaggccgaggcgggaggatcacgaggtcaggagatcgagaacacctattaacacggtgacaccccgtctgtactaaaaatacaaaaagttagccgggcgtggtggcgggcgcctgtagtcccagctgctcaggaggctgaggcaggagaatggcgtgaacccaggaggcggagcttgcagtgagccgagatggcgccactgcacttcagcctgggcgacagagcgagactccgtctcaaaaaaaaaagaacaaaaaaaccccaaaaaacaaaaaaactaaaactgggtattatgaaggaaacttgagaaagaaaagtgaccaattttagttgatgcaagtaatctcacgtatcctcttcttcctgcatagcaagatactacaacccatgactgtcaaacctgagacagctgaagagcccagaaaaaaagattagggaagaaaacagaattgaaaaataattcagaatgacagaggctatctgcagcattaagggcaaaggcgggtaaaagaagaaaagggagacagaataaaagataaaccaaaaaattgaaacaaaatacacgggaattcaaacatttataccagaatataagggaataccctggaatctaaacacctcttcaggcaagaatgtgtgtcaatacaaatgcctggcacattgttttccttccccctttctttttacccagtttacccagttttaaaagtgattttttaaaatgcacctttaaaagaacatcttttgttaagtgacttaaacttgatacatttcttggattactaaggaggttaaagtcacatttggtgaaaaaggggcctatctcctctttcctcacatacgggtcatcgaatacttttaaaagcattttccaccatgaatgaggggaaatggaagaaaagaggtggtgacaattatttgcattttccaaatggacggaatgagcctccggagggtacacgaggtcaccagcgtgagcccgcggtggagctggaggcgtatttatagctggctgacctcagtcctgttgggccctcgccgctccttatcttatgccgctggaattcgcgggctcgcaggtcacaggagcccgggcgcgccgggcctggcgctcccgaatcgatgagggaagccgctctccccggcagatcctcccggccggggagcctccatcaccctgcctgcgcctcggcacgctggcaaggagcccgggaagagacgccgggagcggtgggtgggcgagaaacaaatgcaatgtgacttatatttttctttgtcgcaactaccacgacctggccatcccccaccttggtgacttggtgccttcccagcgaccttatttcacgccagctgactggcgttcaccgcagtgtgagtgtcggccggaggaggggtccacgcgaaagagcccgcgagagtggggatatccggccccgaaggccggagcgggcgtccagggcgccgatggccgcagcgcccggcagccgtgtccacgctcccctccgccgcgttccatcgcgtgctacctacggcgtctgcgggaagctacccgggcggcagctgtggggctggcttgtggggaggggccggcgggcccgcgcggaggagcagccccgactcccgcccgcaccagcagctcggcgcccccttgccggcggctggccctcctccccggcaactgggcgccgggctccgcgaactcttcgggcgcttccgccgtgcgctcggctcttttcgtgtccggggcggggcggggcaggcgcccgtggtcgggtgcgcgcggcgcgggcgggggccttcccagtgcgcgcgcgccgtgcaaggcccgcggacgcccgcccctcccccaggcccccgcacccgcgccgccccctcccctcctggcaagagtcggcggcggtggcggcggccgctgcagagattggaatccgcctgccgggcttggcgaaggagaagggaggaggcaggagcgaggagggaggagggccaagggcgggcaggaaggcttaggctcggcgcgtccgtccgcgcgcggcgaagatcgcacggcccgatcgaggggcgaccgggtcggggccgctgcacgccaagggcgaaggccgattcgggccccacttcgccccggcggctcgccgcgcccacccgctccgcgccgagggctggaggatgcgttccctggggtccgggtgagttgggagtgcgcgtgcggaccggaggggctggccgcagcggggaggccagaggggctcgggcgaggctgcagaggcagctgggcgcgcggtggccggagccaggggctgcccggcccggccccggcagctccgcaggcctcggcgcgcgctgggccgggaccgcccagccagagacccacggcaccccgcgccgcgtcccccgccggcccctcttttgtctcccactcgcgggttgcaggccgagtttggggatgcggagtgggcgaaagtcgctccggggacgcttctggaatccttaaatgggaaaggcgctcacctccccgccccggagcggcgaggctgatatttgtgatttggctccggacgctgtggggaggaacaggggagaacaaaatgagtttcgggcgggggtcgagtgagaggagcagccggcccgcccccgagtccccgcgggaaggggccctggcccccgagctcccggagctgcttcacctgttgtcctgcgcggcctccgctccgtggcctggtgattccgtacttcagttttggaaaactttctgctggattgcctggacccttttttctctttccagactcctagtggaaagatttggcaaggaaaaaaaaatgagcttgcgtcagggaagaaaaataatatgctgtgtgttagggtctggcgtttgagcgtggtactctttcatgctctcagatgttttaatttggtcaaactcctgcaggttttctcttttaagcggttaacaaactgttcagagtacatagtatgaacttggcacctgtgttacgtcatttaatccttacaacgattctggtttattgtattcctcattgttttaggggaagaaaccgagtcgcaaagaggttaactaacttgtctaagggagctgggatttgaacccaggaacatcgtattctggcaaacgaattaggaagaaaaaaaaccaaaactgtttgcaaacacttttacgtttaggaacatttttcagttactcttacttgaaattatcgctattttgttgctggagttgaaaacaactactttattgtatttacttgtgagaggagttaaactttgaattagagtgtaacttaatgcgtctcattgttttcagttgttgaaataaagaatgtgaaccagaattatttagatttttaaatttgaagctaaaatatgggcaattctctgatctaggaatggggtgagtgtatgaaaggccgattgaaatgtagaatgcgtttttagtagaaccagactcagttcttgtttaatttttcctccattttccgtggagcccactttaaactttttctactttcttcacttctccccaccctttacagaagaggttgaggcacttagcaggagctccttcattaaattccttctgttactggcttcttaaccttccgtcaaagagggagaatttttttttttttttttgtctttcttattagttaacaccttggggtttttttcctttccttctaattttcctgcttagtggagcgtgagttattttctctgtcgtatttgggttctttaaagtacaaatgttcttaagattttttcagtttacaaaaaccttttcttaagtctgctactccttcaagctgtcttgttgctgcttttccttttcaaatcttattaacattttaaaaagcttgttcgtaataaaagtaacacatggttgttaattgcgaactagcgcaacattgaaattaaaatttagtcattcacaatccatctctagagattgccaagtgtagtctgcttttcctgcctttgcctggttggtggctagccactcatttcttaaccccttgttatctggatttcaccttcacaaggaactataacctaatcaacacatttaactacctttttctaagtcctctccttgagttttctgtaagatttaacatcgacttcacattttcagatgcctctccttgggtttcattcatctatactcgctgtattctaacacagggtccaaggcagtaagatacaacagatccttccctcatggagcttaaagtctagtggggaaatacttattgaaaaataaagtctctagttaaatataattgtgattttaattaaggtgcagaatattataagaacttcaaatggagacctgatctggtgcttgtggtggtgggagaatctgggaaagataccttaaaattgctttgttggaacccaggcagattgtgaaggatgagcaagagttaactattaactagatgaagaggggccttttgtgacattatactgactttgttcctctccgccacttttctgccttctgtttcttctttcctctttaatatgcgttctccaagtttcacttttcagatcacttttctctatgtctctagtcccttagaatgattgttcagacctttctgttggaataattctcaattctttgtttatgtgtcttctgaatcacgtttttttgtttgtttgttttgttttttcttttttattcagttgctttctacatatctgtacctgattgttctgagctgcttttccttagcaaacttgcctctttggtgttctttatttttgttgatgtcataccaaacccaaaccttttcccatttcatcatatcttgtctgtagccaacatctgttgattctgctttatgatattgtaactcttctgctctctattcttgctaactgtggggcaattctgaattcatattggtgtgaaggtagtagtcaaatcataaaacgagttgggcagctttccttctttttctctttttcaggatcattttagactgggattatctgttccttgaaagtttggaagacctcccctatgtgaccatttaggcctagatcttttttctggagaggactttgagtaacacttcaatttctttaatagctgttggtttgtgtcgattttctgattctcatatgaattttaatgtttcacatttttttcaggaatttattttcaaatctagtgttatttggctttcacgtagttctccccccaccaccccgcgactccacccccaccccctaactctaaatcaagttctcatcccacctggactaatgttatgattttcttgccttcacttttctcctttatctaatcttatgtatttctgcctaaattaatctgtaagcccagttcttaccacttcgccactcagaagtttcctaggtcttccattaaatgaaatattttctgtggtatttgcctcagatttacctgtttttttttttttttttttttaataccttattgttttttctttctttctttctttctttctttttttttttttttttttttttgatacagagtctcgcactgtcgcctgggctggagtgcaatggcgtgagctcagctcattgcaacctctgcctcctgggttcaagggattctcctgcctcagcctcccaggtagctgggaccacgcctggctaatttttgtatttttagtagaggtggggttttgccatgttggccaggctggtcttaaactcctgacctcagttgatccgctcgcctcagcctccctgtgctggggttacacaggtgaggcactgtggctggcctttatagcagtttttatacaaatattagtttcactactagtttgcagggtgggtctgtaacggacttttcttgcatattaaaaggaataaatggggaaaggctcctgtctagcctaacagtagctgttgaactgtcctgatctgactattggatcttaggagcagcgaaccatggagagaaaggaaaatgggtttcctatcacactaaattttgaagtaggaaccatttcttttccttttctactttcccaccttttactagtttttaggctttaggatgtctttttaacatcacaaggtccatattgaccaagttggaccaactttttaacacaagattaaatgttgacttgcattgagttatgtccattgtaagatacacagtagtgttacagaccacttaaaatatgcttctagttgtaagaagccattgattgtaaggtgcaccccaattccggagatgctaaaatatgaaaaatggatgcatcttagaattgatgaatagtgtttctctccctaatcaaagctcttggatgtgcctggaaatccccagtagtgttttttgaaaagaacactagttaggggcatagggagatcagatgatcagtagactccatctcagggtggcccctgtggtccctaagccagttcgtatgggcagtttaatatataactaatgagtagacattgaatagatgagtaaattatctttgagtatcttttatttactctgatgttgtagactttgttactcttttatagttttatatttctgatgagccttcctttcttatggcacagatttgttatactgttaaagtctggaacagtggagcttggctcttgatccagctgtatataattggctgttgacttatgaaggaggacaggagtatgctagagatagggataaaatattataatcacatttgcagttagggagattagttacatgttggaaaatcattttgaagaaaggaagactgaagatgttcaaacttgtaggaaggtctttctggcctagcccggattaaacccatttatgcctagtgttccactattggaacgctaagcacgtgggagttatttatatcctgctcaaggtcatcaccaaggtctgattgcaaaaattcaaaaaattgcagcctcaggcataaatgggttaagatggtggcagataattagggcctggaatggataggaggcgataactagcgtggatgagagaaggaatgggattggcaagaacaactcctggatttctagcttggaaagcagggtagatgtgggtgacagatatgaaaaatgaggtgggagagctggtttgtagaagaaaatagtattggatcacatggagtttgagatatctgaaacagccaagtagggatttccacttggcagttgtctatatgggtctggggtttgacagaggtttgtgctggaggtaggcatttgggagtcattgctgtatagattttatattccaacagtgggaattgggtggctctctcaagtgactcttgcttacaagtgacagccctaactcaagttagcttaaaggagggaaaagcttctccccactaacccccatgatattgaaaggtctagaaatagacatggctggacctaagtgctcaaatgatataattaattgaggttgtcttttctgttcttcacttttgtggtctcatttcaggcaggtgcatatatctggcagaggaagacataggttataggttatagaattacaggttataggttatagacctcgtatcgagaactccttgtatggtctagcaaagagcctaaaacagcattgagaattttttttctttctttttgagacggagtcttgctatgtttcccaggctggagtgcagtggtgcgatctgggctcactgcaacctccgcctcctgggttcaagtgattatcctggctcagcttcccgagtagctgggtttaacaggcgcccgccaatacgcctggctcctttttgtatttttagtagagacagggttttgcctcgtgggccaggctggtctcaactcctgacctcaggtgatccttccgccttggcctcccaaagttctgggattacaggtgtgagccactgcgcctggccagtcttgagaaatttcaacttaaggcctgggtagagaagatagacattaaataattatctagttgtagttatgttaagatctacaaaaaggaagtccagggaatgttacaagactgataagggaagctgggctgttcaggatgcgggtactttggaaggctttcctgagaaaggtagcccgcagagtgagaccttaggcaagaaaggacaaggagactgtttttggaagtattcagtagtatttatttatttatttgagacggagtctcactctgtcgcccaggctggagtgcagtggcgtgatcttggctcactgcaacctctacctcccgggttaagcgattctcatgcctcagcctcccaagtagttggggtcacaagcgtgagccaccacgcctggctaatttttgtatttttagtagagacggggtttcgctgtgttggtcaggctgatctcgaactcctgacctcgtgatccgcccacctcggcctcccaaagtgctgggattacaggcatgagccactgcgcccggccagaagtattcggtaaagtgagcagtttttgcagctttttaaaaattttaaaggcaatacatctattgtgggtaatttgggaagtataaaaagccataaagaagcagcggaatgattaagtttcagcttctaattttttataaataatgtctgatactggttttactactgagtacctattcaatcacggatgccacactaacccaatccgaatcttcgtttctttatcttaaaaaatagaaggaacatggtgaactttaagataatttttctgcttaaaaaaagaaaaagaaagaaaatatcttgacttgcagcacagttagctgccgaaattgaaggtcatataatgcttttggtcctaatgacatcactggacttctgacttttggctgaagaatcacgccagccttggcagtccttgcaagtaccaaagggagtatggcttatgcctgcggtgcccttcccgtatcctgctttcttacctccttttttgagcattaatttttttttctttagcctttgggtaaagtatcaaaatgttgagaagatagactctcaattttgaaggtgagaaatctgtaggagacttggatagttgtttttttttttttttttttgagacggagtctcgctctgtcgcccaggctggagtgcagtggcgcatgttggctcactgcaagctctgcctcccgggttcacgccattctcctgcctcagcctcctgagtagctgggaccacaggagcccgccaccacgcctagctaattttttctattttttagtagagacagggtttcaccgtgttagccaggatggtctcaatctcctgacctcgtgatcctcccgcctcagcctcccaaagtgctgggattacaggcgtgagccaccacatctggctgacttggatagttttgatactgttttatgtatattaagatttgtaggtagttttcttactagtaattaaaatgctttgtaatgtatttcaagagtatagggtcttgagtgttttaaatttgtatataagaatgttttagattcctggctaaaagaagctcttgttagaaaatattaaagtaaaggctgttaaattttggtgaggctcttaatgtctgcatttttcaagaatcatttaaaaatgtcatgaaataaaaatatttcagtggtaactgttcagaagtatcttaaatgtataccaaatcaatgaaatataatcgctgggtgacagattattcttccttcattttataatcttttatttaataaaaatgtgggggaaaaattgcatgttgaagttgtacgtgtatattttagcaaaaactgttaatctttctgaagtactgctttggtcatcatccctatttgttaaatatttttccctgttttcttatttgcttacaatagaaaatccagaatatcttggactggtctcctgctctggccaagtcagccttttctgctttgcttcctttcctactattttatcagcctaagtcacgtaaatatccgattcaggtttgggttcagaatccttagacctctactgtccactacaatagatagccactaccacatgtggctgttgaagacttgaactgtggctagtctaagtgtgaattacgtaccagattttgaagatagtaccaaaagatgtaaaatatctcattatgcttttaaaatattggttatatagtgagatgatactgttagggatacattggattaaagaaatatattaaaactgattttggccgggcatggtggctcatgcctgtaatcccagcactgtgggaggattgcttgagcccagcagcttgagaccagcctgggtaacgtggtgagaccttgtctcagttaaaaaaacaaaactgatttcacaggattctttttactttttaaatgtggcaactagaaagtttaaaattacacgtcatattggacagtactgcctttgactttcctttccctggttctttgcccatcagaatgctttaaaatctagtataaatccttggccaggtgctgtggctcacgcctgtaatcccagcactttgggaggccgaggcgggaggatcacgaggtcaggaactcgagaccagcctgaccaacatggtgaaaccccatctccactaaaaatacaaaaattagccgggtgtggtggcacgcctgtaatcccaggtactcaggaggctaagacaggagaatcacttgaacctgggaggtggaggttgcagtgagccgagattgcaccattgcactccagcctgggcgacagagtaagactctgtctcaaaaaaaaaaaaaaaaaaaaaagaatattcctctctctcctatgaagccctcctcagtggtccaagcctcatagttggctctttgctgcatcattatttgaagataatcttttggtatattagatttctttactacaaaccttctcagaacttttaatatgctaatacacatggtgaaactctagtatagtttccctaactacgtattaccatagaactgtgtgttttctgttaacagaagttacacatatttgtggttgaaatttcaaacaatacagaaatgaagtaatgaaagtcttctgtaatcatgcttcacctgtgccccaagattgccactgttgaaagtatagagctagaaaaaattttcttttctgttgccttctttctttttttctgtccccatttcctaaaatggggtcatacgatacatccttatctttaaatttattttcactgaatatatagggggattctttttatgtcagtaaatttcaatttcctcattcttttttttttttttgagggaaggtcttgttctgttgcccaggctgcagtggtgctgtggtgcaaacagctcactgcagcatccaactcctgggctcaagcaatcctcccatctcagcctcctgaatagctgggaccagaggtgcatgctaccatgcccagctaattaaaaaatttttgtgtgtgtggaggtgggatctcaccatgatgcctaggctggtctcgaactcctgggctaaagtgatcctcccacctaggcctcccaaagtgctgagattacaggtgtgaggtgttgtgcgcagccttaatcatctcattctttatagtagttaagcagttattccattttctgattataccttaattttacttaccagtttcgtgttaatgaataattagattatttccatttttttcttttgcattgcaaatatgctgtggtgtttgtacatatcctttgagactgtttttattttatgaaatgaattcttagaaatgcatttactataagagaagccgtgcagattggatggaaagtgccaagccaccctgcaaaatcttcgtaaccattcatattccagccaacagtatttgaatatgttctctcctcccaacataatcatatcagtcttttttttttttttttgagacggagtctcgctctttcacccaggcgggagtgcagtggcgctatctctgctcacagcaagctccgcctcctgggttcatgccattctcctgcctcagcctcccgagtacaggcgcccgccatcacacctggctaatttttttttgtatttttagtggagacggggtttcaccgtgttagccaggatggttttttttttttttttggagaccgagtcttgctctgctgccaggctggagtgcagtggtgccatcctggctcactgcagcctctgcctcccggattcaagtgattctcctgactcagcctccggagtagctcagacaacaggtgcacgtcaccatgtccagctaatttttgtatttttagtagagacagggtttcaccatgttggtcaggatggtcttgatctcgtgacctcgtgatccgcccgccttggcctcccaaagtgctgggattacaggcgtgaggcaccacgcccggccatatcagtctgtttttatctttgccagtttgccagctgaaaaaacattcatgatataaggtttctttgctgttgtatgaatattaaaaaacaaaaaattttaagtttcatttgtcttatactctcaacttgttatacgctcctttgatttttgtgctaaaatatttcgtattgctaacagtacacatgcatgctttgtacaaagtaaatgttcagatatttgtatctgttcatggcaaaggcgtccagaatatgctactgcaacataaaaattatttggaaacctggtggctcatgcttgtaatcccagcactttgggtggcggaggcaggaggatcacttgagcctaggagctctagaccagcctgggcaatatgttgagactctgtctctacaaaaatttaaaaatcaatgagatgtggtggtatgcacttgtagtctcagcaactcaggaagctgaggtggggggatcgcttgagcccaggagttcgagactgcagtgagccatgatcttacactgcactccagcctgagtgacaaagcaagaccctgtctcaaacaaacaaaacatatattttaatctggaaacatttgagaatagcttttttttcctcctgaactcccttgtctgcctaaaactagatcctcccccaaagaactcaattgtcataacttccagttgtcataaatcccttccttgggagttttgcaagcagggaagatggtctcttgtcgctggagagaatttggcaccacacctaaacagacattgttataaactatcctatgtccaactgttgtcctaagggtccatttgtctttcctacatgttacttgttttcctgcaacagcccattgttcttttctagttccagttcccctagtaagatggtacacatgccccaaattcggacagcccccttgggtcacatttttctgtgaattattctacatatgtgaatcaaatctgtcatttctcttgcagatgtgttctttgtcagtttaatttatcagacctcaattactgaacctaagagggtgtaggaagtttttcttctctgacaatggccaaattgatatttttctggctgtaagggcaagggataataataaagtaacgtttttctaagaataaatataaatatcttaaatataaagagcgtgagtaaagtttctttaaagtacattaaaaaaactgttatccaaaatgaaacatttgttaaaagaagtggattatgctattaaagatgtgccccccacccccatgtgtttgttcctatcgtagtaatgctgattgttaatggatggcatagtaactttaattgtgttcacaggcctttgttcttaaaattatgcactcttccctgttttttcttagcattttatcaatttgcatagaagagaaaatgatttgtaacaggtttctctggtcacatcactgaggagagtcaacaaaagaagtcattcaattgaggttaaatctttacacaaagaaggcattaatagcttaaaagaataaagaaatcctgatatggttattgtgacttttccatttatctggttatgaaataactaaaaaggttaattaaatgttggcttatttctaggtttagttatgcatcggtgtgtttattgctttctgtgccttattacactctgcttactaggtttgtgaccttgagccaaagttgttaattactctaagccttcttttctcatatgtgaaacaaggataataatggtcctctctctcagggctactgtgaggactaaatgaatgatgagtgcagttcagtgcttaacactgtgcttgccactgtagtagcttaatgaatgttagtgaagatgagtatttctgagagaaataagcaggacagttctatcttaaaatgcaggtttgaatggcttcacatacagggtccttgaaaattaaatctgatcttgttgctttctaaaagtatgcattattttagcttccatgttaatattcacatttgaatttgcaaaatgcttctgtgtatcatcagtactggcaaattgatataggaaattttgttgcttttcctgctttgtacatcaagaattggaggctaatgaaggttaattttcccaccaatgtcaaacaagttggtgtaaaagagtaaatagatctagagctgaactctgtagttctacctactagggaggctgaggtgagaggatcacttgaggccaggattttgcagctgtaatgcattatgagaataatgtgctatgtaaatagcaactgcgcttcagcgtggacaacatagcgagaccctgtctctaaaaagaaaaaagtaaatagaatcagacttttcctcattcactcagagtggatgattaggacctcaaagttacatataaagtaaagtcaaagactccacatgctaaagaaagccctaggcattagtggccagaatcctttccagggcttattaagatgtggcagaattaggtcacaagttggggggagaaggaattgtgccagaattgtcattgcagctattagtttgcctagcagggagcactgtagtttttcttcccttctccttcccttggagtgtccttcccttagaaacttagtgtggagaggtctaagagaaccattcctggaggttaagaatactagcagaagatggaatggagtatctgattacctaggcagtattaattacgcagcaggctggtttatctgtacctatttgagcaaaggataaggaaaattagaaatcccagtgtggatggaggggtggcagtgaccttcttttagttcaggtgggtaatgcagatgtaaccaggcaccagccttcttgccaggcaggctgtgctggacaggggagcaaaagtagttggaagagggtgagctgaggctgggcaaggtgatgcagacctataatcgcagtactttgggaggccgaggtgggaggatcattgagctcaggagttcgagatcagcctgggcaacatggcgaaaccccgtctctacaaaaagtataaaaattagctaggcgtggtggcgggcgcctgtggtcccagctgctcaggaggctgaggtggcagattggcttgagcccaggaggttgaggctacagtgagctgagatcgtgctactgcacatcagcctaagtgacagtgaggccctgtgtcatattcccagcttcttgggcaactgaggcaggaggactgcctgagcccagaaggttgaggctgcagtgagctatgatcttatcactgcacttcagtctgcgagagagagaccctgtctcaaaaccaaacaaaacaatacaacaaatggagggtgagctgaagcagatcttcaggtgggctgagagcctctagtctcctttgtcatgaaagaaccccacttgtccccagaagaaaagctatcatttgtctgcttgtgatacagacagtgtagtcagtattagccaggaaagtggcaactgagatagctactccagtctctctcctccctcccctattcatcagaccacaccccttcctccaggctagctctcttggactgggtgcacccaatctgaatttgaagagaaaggaggtgattgtaagactgaagattaacgttttaaactgtactttttaataaccaaaagctataggaacttttcaagatctccataagaagtggaaaagggagatttgaccaaccacaattagggatagggatagagaaacaattgtttcttgtgtttgtaccgatttcagaccctttgttaagagccttaagttcccattaccttaagttcccattaaggcctttggacacattaagttcccattaagttcccaccaaggcctttggacaccaaatcccattctctttttctccgtatgaggctgtcacagtactatagatgaccatttgatcttctcagtggcctgtttccaaatgcattctgattctcaatactattttagcattaagtgtatcatttaattttatctcagatttataagctgtatattatatgataacccttttaattggaatattaattcaaatatcttaattcctttttatggaattgttggagtttatcaaaccttggaaacgttaaataacataaaaagcactcaaaaagaaacactaattcaatattttatttttacttagtgtttgagattttgaattttagaaagttttaaattaatattcagctgttattcacatataaaaggtaagtaggttttagtttaaagaatgttgagcaataaaatataagattgagatggattaaatggtatctgacatatttccttactctgaatcgatttaacctttacaagtattctatgatatagttactattatcagttcccttttacatgaggaaactaaggctgcagaggttaagtagcttgtcaagggttgcatagttcctaagtggcagagctgggattcaaacccaggcagtctggattttagagtccatgctcttaaccacataattatattgtcaaatggaggaggagaattttaagatgaggatgtgtactaggcacagagttgacttttaacaattaacctctcttttaatatttaaaacgtggtagagattttccacatttaaattttccacagttaatctttgagattgattgattgattgattgaagcagggtctcacgcattccattccccaggcaggagtgcagtggtgtgaacatggctcactgtagcctcggctgcctgggctcaagcttagatcctcccgccttgacctcccaaagtgctgggattacagctgtgagccactgtgcctggctccaatttatacttttttactttactgattttgtttttcctttgcatcttaaacaatattaaaaggtcagtggcatatagttgtttaaaaaaatatttatccaaaattcttcccacataccttctttaaaaattagtgcttttttttttctcatctctgagatgtatacatgtttaattggcgatggtcagagataggttttttttttttttttttttttgagacagagtctttctctgtcgcccaggctggagtacagtggcacgatcttggctcagtgcaagctccacctcccgggttcacgccattctcctgcctcagcctcctgagtagctgggactacaggcgtcctccaccatgcccggctaatgttttgtatttttagtagagacggggtttcaccgtgttagccaggatggtctcgatctcctgacctcatgatctccccaccttggtctcccaaagtgctgggattacaggcgtgagccaccgcgcccggccagagatagatcttttttcacagctttaccatgagtattactcttaaaataaatgaccttgggtaggtgcttgcataacataattatgttatttgtatcgtttcatagaataaattaaaacctaccctgtgagagaacaagaagaaaaagagagtcagttgaaaatgaaagtgattaagtccatctgtggggcagtttttggagtcagattgagaaatgaaatctgatttttacctgttaatgctgctgaataataataatatggaatattattaaattgcttttgttctcttaacagtcatttaaatgtaattggttatggcatgtagacgtctaaaaatcatcccattcctttaaagtttcttttcaaaacaagtcttttttccctcctgattgcaaaaataatgcttacagaacaaattgaaacacatagaaaagccctgagaagaaagtaaaaatcccctgtatttatactactcaaaggtaacatctataaacattttggtatatatactgtaagtttaaaaaattctacaatgtttctactgtaatttaagaatttgtgcaaataagttgagtaaagctaagttcatcctgagcgtctgaacctggaatataaggaacttgaaatttgtaggggtgggggtatctgaatagaaatagaaagttctgaaaatttggctgtcttattctagttatcttttttttttttttttcctgaatgttcttcctttccttctcagcttttgccacttttaagtttttttttttaatcaagatgtttcacatttgatatgttcttcagtaataatagactaaaatataataagatgtagggaagcagaacctaaactgtaggaggttaaaaaccagatgaaggccaggtgtggtggctcacgcctgtgatcccagcactttgggaggctgaggcgggtggatcacctgaggtcaggagtttgagactagcctagctaacatatagtggaaccctgtctctactaaaaaagtacaaaaattagctgggcatggtggcgggcacctgtaatcccagctacttgggaagctgaggcaagagaatcacttgaacccgggaggtggaggttgcagtgagccgagatcacgccactgcattgcactccagcaacagagcaagactccgtctcagaaagaaaaaaaaaaaaaaaaaaaacacaacaccagatggaaatagaaaatctaaaacctctagcagaatgaagctagaaagaatggaatctaaacactgaaattatacatctgctaggcagctgtgcgttctttatttataggttctgttgtggaaatagcaaaagaaactttgaaagaaaaagatatcttaaatagactaagcatatattcttatcactgtgatatgcacatttttagctgtacagcatgtatttcattctttttttttttttttgagacagagtcttactctgtcgccaggctggagtgaagtggtgcgatctcggctcactgcaacctgtgcctcctgggttcaagcgattctcctgcctcagcctcctgagtagctagaattacaggcgtctgccactacacctggctaatttttgtatttttagtagagacagggtttcaccataatggccaggctggtctcaaactcctgacctcagatgatcgcccgcctcggcctccgaaagtgctgggattacaagcgtgagccaccgcgcccagcctttaa

SEQ ID NO: 3 - DNA, 29256 bp, Homo Sapiens
acgtgaaactaaagataaattaaggagctaagtttcaaagaatcagtataagttgccttttcagtaaagaaactaaagaattaacttgaagtagaaagaaattttctgaatttgcaatgcttttctagcttcaaatctccatcctttggtctttggtcccacgattgtttacacacctcaaacaccacaaatgtcaagtgtaaacacaatttcacataaagttttactgcacagaaaacagagtatggttaacttaagggggttacttacctcatttgatttactattcattttgggggctggttttaatatgtgtagtgtatgcctgaatgccctgtgctaattccattgataatttttgttgggattagggaacattgtgaacaagtaagtagaaaatgagggctgggtgtggtggctcatacctgtaatcccagcactttgggatgccgaggtgagtggatcacctgaggtcaggagttcgagaccagcctaaccaacatggtgaaaccccatctctactaaaaatacaaaattagccaggcatggtggtgcatacctgtaatcccagctactcaggaggctaaggcaggagaattgcttgaacccaggaggcagaagttgcagtgagctgagatcatgccatttcactccagcctgggcaacaagagtgaaccactgtctcaaaaaaaaaaaaaaaaaaaaaaaaaaatgagatttgttactacttgtaagacctgtggctagcctggtactatatttttcatatgctagaaaacatgctctaataaatatctgtgaatgaatagttattttacctgccatgtccttcaccccaacagagaatcatcagattaaattttccatttccttgatccacaagatttcgggtatacctaaaaaaaaacaatatattcagaagttttaagttcgttgctgaaacaagcactggaaaaaataagtgtgtcaccaagtaccatttattcacaaatgttaacatttccacctctaagcaactttgaatgcagttttctaattagaaatccaacacaaatgaaaaatcctttttcacagttcattttgaaccgctgcatttacagaggtagctgctcagttttaattaatggcacgggaaaaataacaggaaaaaaaccgaaattgcatgtttctcaatgtgacagcctcaaactgatggagtaagtttctcagagaaagtatttccaaagtgcattactggttgaggcaagaatgttgctattgtttttttttttttcttttttctgcctgtagctaaatcaagacttgagaaacaaggtttcattaaatagctgttctagaattcttagttttactaaagcctagacacaaaccacattcaaaagcccttataatgaaaagtcttccacaaataccgtgggggctgatctaactaccagaacaaagaagactacattagtgaagtaaagaaccctctaaacctcttacaattaggagaaaccagtaactggcaaacacatacacacagacacactcaccacaaccaaccaccaccactgccaccaccaacaacaaactgcaaaccacgaccacgactgtgaaaaaagcaaaatcaacgtcaaagtttctattggtccaaggtgtactgttgacagcatctagttagcaaagtttcataattatgacattcatttagactgtcatgttaaagaaaaggggtctttactccattttttgggagttttttttcccttcgtcatcggttaactcttgtccagcatgccccttccatcctgtcccattcctccccaccccgaggtgtccgaagagcatgatcctagagggagttacttagtaagtgctttttagcctcagttttccctactttgtagcctttatgacctaacaagaagctgtgtacacaaccttcaattcacagtaaactgagttcctgcagaaggatcctaattcttcctccagaagtcttaggataatctttgttgcttctctgcagcttctttcaaagaattcacagcctggcccacacgggagcatattctgtcttgattcttctgcactggccctcccaaagtcagagaacagaatccttcacagcgctaggcacctatttaatgcaaaaaatactgtagaattgacttctctcccatctcctgtcttcccccaactgccccctcgggactacatccattatgttaatgagctgtacctcagatatctgtgaaaagaccgatcaacccagctggttgcacttcaaaagctttagagtttgtcaatcgagactagttcaaggtccttgaaaatacacttgttctaaagattaaagattaaaaactgttacaacctgtcctggtttaacagtggtttagagtgtaggctctggaacaacaatgctaaccccgggagcctggagccgctatcgatagaagacctagtgcaagtcattcaacttcttcattgcctgccattcctcatatgtgtcaagtgtctggaagagtacctgtcccataacaagtcttcaattacctggagcaaatgcaagaaaatttaaaagctagactctctgctagctttcacggctacagaagggctctaccatgaactaagctgataggagccaaaggaatttcctcaagtcacttgtatatgaaaaatgggatccttagtggtcttcactttttctatttcaaatcctaaaatacagttgaaaccgcccatgccaacaaaactttacgaaacatcccacatgttgaagagtgactaaaagaacctgctcccaagaaaaacaaacttacttctttccttattcttttctttcacttacccctttctcctaaccctaaacccaaaaaaccacaaagactgacgcactaactgctcagaaaaagtagaacctctcacacttcggggtgattaaattttacctctggccccggaggattggtagagagattcgacttaatcaccaagccggggctgcaaaaaagccagcttaccagggcacctcactcaagtacatctgggaagtaggggtctttaatttacattacagatcgtcagaagcaaggataagataaatcagatcatttgggggctgaaaaaaacgacggtcgaatatttaatctgcgaaacttggcagtggatttgaataaacccacagtcggggaagttagttaaattggtttgggaaagggaacagcagaaattccgtagtggcagctgacggccacaagacgctattttacatgagtaaaaatgcttgctataaggtgcccggttgcaggcgaccgaaggcgcagtgatggagaactgacgcgggtgacttgtcttcttcaacatcacacacttctcccgatggctgatgtagtgctcccctgggagcaccctctgctagtccggccagacggttccttaaggtgtcaggagggcccgaacctgagtgcggtctctccgcatctccgcgcccggggttaacgatggcttgggagtgtgggcattgctcccgaggccaggggcaggaggactggtggtttagaagcagaggggtttgcgggagagaagagaacagaaaatctcgcagacgcgcggtggcctcccttcccggcgcctgtccgccgttcccggccggaggtcagcaaggccagtaggatccaccttccgcctgcgctgtggccgcggagccccaagcgagtcgtgccagccccgcggctggccagcgagggggcgagcggcggacgcagcgcggcccgagcttcccgagccagtcactttgggctgcgtcccccacgtccattcctcctcagacggggcgagtgggcgccgcctggcattgaagctgcagcgcgctcacctgtactggtcgaacttggcgtacattgcccactcggtggggtcgctctcgtaggcttccatgatggcctgcacctcctctacattgacctcatcgccggcaaagagctggtgcaggatgcggatcagatcagccagggtccgtggcttcagcacttcggtctgttccatctcgtggggagctggctgcgcgcgcgtctcactgctgggctgcggtggaggagctgagcgagccaaggagctgggggcgagggagcctaacagcccgctagaccgctaagcagacacacacgcacaaacccagcattagagtgccgaaacgtaaggatgtcgtcgcagagacagcaagagacccacccccaggcccctggcagcgcagtggatccgggatcgctggagacgcggtgcacacacaaatcaggttcagatctgtggggttcatcctcccgggccccttttaagcgcttggagtcactaggaatgtaccaacggccctcggagggaggacgaggcggagagccacccaagaaaggtggcggaggcggggagaccctgcgggcacggctcacgcgcacatccccggcttccccgggctccgcgccttcccaagagccccgttgtctccggcgtcccagggatcgcgtgggctccgcgcaatctctcccccactttaacggcgcgttttagccgcccggcctaacgcctctccccgctccacctccgccgctgtggttcgcgacgctgggacgtagacaaaaagggtcggaggagatggctgcggggactgacgctgagtaaaggaggaaaagaaaagggaaggagagggacacttcttccaaatagagaattgtgaggagcctgcgaaaattgaggatggattccactcctaggccagagagtgcctgttttgtcgattgaaactatccacgatatgccccaggctaggtgaaaataagtccaagactttatatatatatatatttaagtatacacacacacatattttttaaaatgcgtactgaaatatattttgacaaaggagactcgggtctctagtaagacaattagtgaaatgatggaaaaccaagaactctttgattttaaaatcaaatattttcttttaaaaaatatccagtgcaaataacctgatatttcatttgatggtgtaaaagggggctttttctgaggggatagggcgggctctgacgcaataatttaagaggctataattatatttgaatctttcaaccttaggcatgtgcttgaaggagcctgctagtacatacatataaggaaacacgtttctacgtcatgcatagcacctagtacgttgggaacaacacaaatcaagtacagtaggatttaaatgagaaagatgtgaaaggtggaagaaatgcaagtgtagatttcttccttctcattatggatggacgcagggaataatttggatttaaggttattaaagttctagacttctgaagacctgtttttttctagactatgatcaccctccctcgtgtatatacatgtatacaatgaaatttacttgtgccaggtagtcttaaacatctctggtaaaactcgctacattatattctaacagtgttgttaaaagcggaatcacctattgttcaaaaatggctacaagtagaaagcattccagaagccagccttggtgatgtgtgttgctgcggggtagtgaattaacaaagtattttgtgacagagtaacctgtaaacttttcatggtttcctcaaattattttttattcttggcaatgttttctattgagtctcttaattacttcatttcagctagtctaatccataaatgtttggaatgaacaacaaaaatgaaatgcaagcacaatttatcttttctgcatttcagttgataaaacttctaaatttttctgacaattcattttctttctctgactcctctttttctttttacatttttatgaaagtaatatattcacgtagttaaaaaaaatcaatagtactggaaggtcaatgaaaagcagcaggcccttttaaccattcctgaccatctgtcctgtgcttaaagagtcagtctcttaactcttctaactattccttgtggtagttacttcctttttccaaaaataggcttatatttttttttgtttcagcaattttagatattatctagtcattttacattatgatagctccattcgtttattattcattcattaatttattcaacaaatgttttttcgggtgaatagaaattttcatttcacctgagtaaatacctaggagtgagattgctgggccatttagtcagtgcatgtttaaatttgcaagaaattgacatactaatttgcaaagggtctgtgccatttcacattctcaacagtgatgtatgagttctagttgccccgcatcctcgccaggtattgtcagttttaccaattttggccaaatagaggtgtgctgatattgcattgtgttcttcattttctatatctctaattcttatgggcaggtctttgttcttagagctcccaagatggtggccaccgctcccaggatggcagcaagccttttgttctctgaactggggttcttggcctcatggattccaaggaatggaaccttggaccatgcggtgagtgttatagctctattagaagccgtgggtcacagaagagaaccgtggaacccagctactagtgttcagctcaaataggacgaacccgggcacttagccatgcaggaacaatggcaagcctttagccggatcgggagtggcaatgggtgcctcgctggatcagcaaagcagcggacaccctgccggatctggaggggtggaagtcggtggcgggtctgtgacagtggcaaacagcagtggtgaaaagcgagcgaaagctcagctcgagccataacaaacacagaccagaagagtgtgcagttgctagatttaatagagtgaaaacacagctcccatacaatgcgacggcacgcaaagagggttgccactccctgctttaatgcctgggtttatatccggatcattgtccctcccccatgctctcaggcgatatattatttgactatttctttacctcctgctttagcctaatttgtattttagtgagccctctttactgcctgattggttgggtgtgagctgagttacaagccccgtgtttaaaagtagttgcagtcacctttcccagctagggcttaggaattcttagtcggcctaggaaatccagcttgtcctgtctctcataatgactaatgatgttgagcatatttttatgtgattagttatttgtaaataatttttggtgaaatatccaagtattttgtccttttaaaaacttaattatctgttcttattgttgagttttaagagtttattatatattctagaaacaagtcagatgtgtgatttgtatatatttcctcccagtctgtgactggtcttttgtttgtttttttggacaaaggtcttgctgtgtcactgaggctggagtgcagtggagccattggctcactgcagctttcaacacctgagctcaggcaagcctactgcctacgcctactgagtggcagggactacaggcgtgcaccaccacacttggctgattttttatttttttgtagagatgtggtcttgttatgttgcacaggctgggcttgaactactaggcttaagtgatcttcctgcctcagcctcctgaagtgttgagattataggcatgagctactgtacctaccctcttttcaactttttagattcaggggttacatgtgcaggttacctgggtatattgtgtgatgctgaggtttctggtacaaatgttattgtcacctaggtactgagcatagtatccaacagtttcaaccctttttctcctccatcctccctctagttatccccagtgtctattgttgccatctttatgcccatctgactccacctcttgaccttcaaagacctcaaggaactttcttaatatactgatattgacacatttttattgtttcttctctcaacttcctcccttccctcacactcaggatttcattgattgtctgtatgtggatgccacccacattcccttagttttacatgcagactgcaatctccaacaccttttggcacctccgatgcagtatgtgtgaaactcctttcaagaatgctcttccaaactcctaaaggttctatttctgcaatgaggcacccaggctcaaaaacctcatccactgctgcctactccttccttgcatcattatccagaccccattcaaccaattgccaagttttgtatctccttatcattttctctactttgtattcttattgctattccactattcaaacctctatttgattttggctggattatggcactggcctctgaaatggattccttggttccagctttctcccatatgtatcctttattcacaattgcttgatttcttagcctaaagcacagaactgatgatgttgtttcctggtcacattcttccaataactctaactttcctatacaataggtcttatcaggctggcattaatttttttttcatattttggctgtaaactacctttcttgatatttcgccttttattatttttctttatgaatatatctttcagccaaattgaatgtgcttaccaaatccattcttttgcttaagcttttccttctgcttaaatcctagccagccatttcaacatgtcccaatcttattttaagatccagcttttactttcctgtcaaatgtgccatttctcctcctcctgaacaatggaacaatcactatcttccttaaggcacttaccatttctcagcatgtattgcaattacttacgtggatcactttgacagtgagaacctttaagacaggctcctcttaaattttatttttatatcaccatcagggcctagcacacagtattttgtgcaggttaggcacaaatagaaatatttcttaagtgcatgcataaatgaaattagtaaaagcatattggctagagttcctcaatactagagttattggctagtaaaagcattcgtctagttcctcattcctctttaaggatcctagggttgtgatttcaaatccagaaaagacttttttcaggttctttgcaaaggacatctgaattcttcccaacagtgttgcatattgtaacctaaatgtagtcattaaaaaaagttgacattatagactttattaacataagtagaatacctagatccagagaggtagctctactgtactctgaattgtccagggcaatcaatgactgtcacattttcagacaggcattgacatggtggtagatataaagagaagggaactatccaacatattttaaaaagcatgtactatatgccaggcactgctaacaaaactaagccactgccctcagagggcttacattttaatggggttgggttggtaggaggagcacaccaacaaatattgtatacagcatacatggagaaatggacatacaaatacttgataaaatacacaatggagaaaaataaaacaggggaagttgggtaagtagagtggcgagttgctgtttcagagggagttcaggggaacatttccttgaggtggtatttgagcgaggactgaaggatattagcaagacatttgtctagggcaagtttccaggtggaagaaccagtaagtgcaacagccctgggattgcagaaagcttagtgtttgagtaacagcatttgggtggcagagtgtggggaagtgatgaccacatatcacataggccaaggtaaagacttcagcttttacaccaatatagaaagccactggggattctaggcgaggagagagtacatacagaggaaccaacgagttagttgttgcaatttgagtgaaaaaaaactatgatggtggctctgtccacagtggtagcagataagaaatggctggactctgaacatgttttgcaggtaaatcagtcaggcttttaaatttttatggatacataaatgtacatatatatggggtacatgtgaaattttgatacaagcatacaatatgtaatgatcaaataaaggtaactgaaatatccatcacctcaagcatttctcatcctttgtgttatgaacattccaactccacttttctagttattttttgaagtatatattattaactatagtcacccaattgtgctacccaacactagatttttttccttctaactgtgtattttttttactcattaaccaaccctttatcattccccttttcctactacccttcccagcctctggtaaccatcatctacactgtatttccataaaagcaacttcattttaagttctgtgatagaagtgctgaacgtgcaggtttgttaaataggtatacatgtgccatagtggtttgctacacctatcaacccatcatctaggttttaacctccacacgcattaggtatttgtcctaatgctctccctccccttgcccccaacccacccacaggccccggtgtgtgatgttcccctccctgtgtccatgtgttcttattgttcacctcccacttatgagtgagaacatgacgtgtttggctttccattacagtgttagtttgctgaggatgatggtttccagcttcatccatgtccctgcaaaggacataaacttattcttttttatggctgcatagtattccatggtgtatatgtgccacattttctttattcagtctatcattgatggaaatttgggttggttccaagtctttggtattgtgaacagtgctgcaataaacataagtgtgcgtgtatctttatagcagaatgatttataatcctttgggtatatacctagtaattggattgctgggtcaaatggtatttctggttctagatccttgaggaatcaccgcactgtcttccacaatggttgaactaatttacactcctaccaacagtgtaaaagtgttcctatttctccgcatcctcaccagcatctgttgtttccaggtttttttaatgattgccattctaactggtgtgagatgctagctcattgtggttttgatttgcatttctccaattgatcagtgatgatcagctctttttcatgtttcctggctgcatacatatcttcttttgagaagtgtctgttcatatcctttgcccactttttgatggggttgatttttcttgtaaatttgtttaagttccttgtagattctggatattggacctttatcaaatggatagattggaaaaattttctcccattctgtaggctgcctgttcactctgatgacagtttcttttgctgagcagaagctctttaatttaattagatcccatttgtcaattctggattttgttgcaattgcttttggtgttttagtcatgaagtctttgcccatgcttatgtcctgaatggtattgcctaggttttttcaagggtttttatagttttaggttctacattttagtctttagtccaccttaatttttgtataaggtgtaaggaaggggtccagtttctgttttctaaatatggcgagccagttttcccagtaccattaccatttattaaatagggagtcctttccccattgcttccttttgtcaggtttgttgaagatcagatggttgtagatgtgtggtgttatttctgaggcctctgttctgtttcactggtgtatatatctgttttggtactagtaccatgctgttttgggtactgtagcttttgtagtatagtttgatatcaggtagtgtgatgcctccagctttgttctttttgcttaggattgtcttggctatacgggctcttttttgggtccatatgacatttaaagtagtttttttctagttatgtgaagaaagtcaatggcggcttgatgggaatagcattgaatctataaattacttggggcaatatggccattttcatgatatggattcttcctatccatgagcatggaatttttttcaatttgtttgtgttctctcttatctccttgagcagggggccttgaaggcccttcatgtcccttgtaaggtgtattcctaggtattttcttttttttttgagacggagtctcactctgtcgcccaggctggagtgcagtggtacgatctgagctcacactgcaagctctgcctcctgggttcacaccattctcctgcctcagcctcccgagtagctgggactacaggtgcccaccaccacacccagctaattttttttatttttttatttttagtagagatggggtttcaccatgttagccaggatggtttcgatctcctgacctcgtgatctgcccacctcggcctcccaaagtgttgggattacaggcaagagccaccgtgcccagccaggtattttctttgtagcaattgtgaatgggagttcactcatgatttggctgcttgtctttattggtgtataggaatgcttgtgatttttgcacattgatttccagtcctgaatatccttgttaattttctgtcttgttgatctaatattgacagtggtgtgttaaaatctcccattattattgtgtgggagtctaagtcactttgtatgtctctaagaacttgttttatgaatctgggtgcatctgtattgggtgcatatatatttaggatagttagctcttcttgttgcattgatccctttaccacgatataatgcccttgtcttttttgaactttgttggtttaaagtctgttgtatcagagactaggattgcaatccctgcttttttgttgttgttgttgttttccatttgcctggtaaatattcctccatctcattattttgagcctgtgtgtgtctttgcatgggagatgggtctcctgaatacagcacactgatgggtcttgactctttatccaatttgccagtgtatgtcttttaattggggcatttagcccatttacatttaaggttaatattgttacgtgtgaatttgatcctgtcatcatgatgctagctggttattttgcacattagttgatgcaatttcttcatagtgtcattggtctttatattttgatatgtttttgcagtggctggtactggtttttcctttccatattttgtgcttccttcaggagctcttgtaaggcaggcctggtggtgacaaaaatccctcagcatttgcttgtctgtaaaggattttatttatcctttacttgtgaaagttagtttggctgtatatgaaactctgggttgaaaattctttaacagtgttgaatattggcttccactctcttcgggcttatagggtttctgcagagatccactgttagtctgatggcttccctttgtaggttacctgacctttctctctgttgcccttaacatttttctttcatttcaactttggagactgtggcaattatgtgtcttggggttgctcttctcaaagagtatctttgtggtggtctctgtacttcctgaatttgaatgttggcctgtcttgctacgttggggaagttctcctcgataatatcctgaagagtgttttccaacttggttacattctccccatcactttcagggaccccagtcaatcgtaggtttggtctttccacatagtcccatatttcttggaggctttgttcattccgtttcaatcttttttctcaatctttccttcacgcctcatttcagtaagttgatcttcaatctctgatatcctttcttccactgatcaattcggctatcgatgtgtgaaaagaactcctgcagctagctcggtgtctgcctgaacagctgcccagttttgtttttgaaacccagagccctgggggtgtaggcacatgagggaatctcttggtctgtggatttctaaaaccaggggaaaagtgtggtatctgggccagataacacagtccctcacagcctcctttggctgggaaaagtaggctcccctgctccttccacttcctgcatgaggcgacaccccactctgcttctgctcaccctctttggccttacccactgcctacccagtcccaatgagatgaacaggatacctcagttggaaatgcagaaattacccacttctgcattcatctcacttggagctgcagactggagctgttcctatttggccatcttgccagccaatcctaaaagcattttttttttaggctcccacatatgagagtatgtgctatttgtttttctgtgcctggcttctttcacttaacatcacaatatcctccagttccatgttgcaaataacaggatttcattcttttttagggctcaagatgacatcatgtacactttctttatccattgatccatgcatggactctcaggttgattatgtatcttggctattgtgcatactgctgcaatgcaggtatctcgatatacagatcttcttacctttgggtttacaaccagcagtgagaatgctggattacacagtagttcttttcttcattttttgaggaaacttcatactcttctccttagtagctttagttatctacactcccaccaacagtgtacaagtattctttctccacatcctcaccagcatccattattgcctgtcttttggataagtcatttaaactggggtgtgatagctcatttagttttgatttgcatttccctggtgattagtgatgttgagcattttttcatatacctgttgcccgttttgatatcttctaagaaacacctattcagatcttttgcctatttttaatttttttttgctattaagctctttatatattcgtttttaattccttgtcagatgagtagtttgcaaatatttttgcccattctgtagcatatttcttcactttgtttcctctgctgtgcagctttttagcttgatgtcatctcatttgctcattttcacattggttgtgtttttgaggtcttacaagaaatctttgcccagcttaaacttttggtttccccaattttctcttcataatttcaagtcttacatttaagtctttaatctattctgatttttgtatatggtgagagaggggtctaatttcattcttctgcatttggatactcagttctgcctgcaccatttattatagaagagattgtcctttccccaatgtatgttcttagtgtctttgtcaaaagagttgactgtaagtaaatacatggatttacttctgggttctctattctgttcccttggtctgtgtcttgtttttatgcttctatcatgctgtttttgttactatagctttgtagtacataatttgaggcccagtaatgtgatgcctctggctttgctatttttgctcaggatggctttggctgttctgggtcttttgtggttccatacaaattttagatttttttttctctatgtcagtgaagaatgtcactggtattttggtagcaattgcattgaatctgtagattgctttgggtagtaaagctgatggattgaaactgggttggaagagagtcaagattctaagcaactatagggatggatttatcattcttaagacaagacttgggaaaagtggggcaggaaagggggaaaggtatgttttgtagatgtagataaaagaactgggaacaaatacttggaggaagcaaggaggcagattttgccatgttgtaagaaaggcagttatgaaacaaatagagccatctcaaaatggacaggacatcctttttgtctatcactagaagtaatcaacctagattcatgtgtatcagctatgacagaaggaactatgggaattgatttataaggattcctctaaagattttactcacgttttatctttcattaatattaaatacgaaaacatgggtatagtagctagtatcaggtatcaaattactttccattatttctaaaaattctattttaaaaacttccgagatttaaattcaaatctgaaaatctgtcctacccccttgagtcaacatgaaagtgactccaagaacagggactttattagtctcttatgagctttattagtgttattccaatatttaggacatagtaggcactcaatatgtgaatgacaggttatacgaacaaactgaagtttatacttacgtttcaaggtttttgatattgccaaatggccccctaaaagtgatataccaactcatattctattcaccaaaatatgacaggatttccccacaactctgctaatagcaagatgtacattatttttattgtcagtcagcattgtttttatttgtattttttgtaaccaatggggttcaaggtgtttcatgttttgttggccatttgtatctttttgtgaatcgaaatttggtatgttttgcctatttttcagttggtcttttcttaccaattgaaacaaattcttcatatacttaagacattaaaaacactgtcatatgttgcaaatattttccattaccttctgctgtacaaaaacttaaactatacaaaatttcctttgtttttagctgtcatactttgctaatcacaatttcattcactcgatgtgttacattactaattatttacatataaggaaatgtactaagtattatgtgtgtgtgggtaccagataaaaaccagaataactggacacatggctctgaggcagtatgcaataagtgatttaatagtggtagtttgctctaagtgtttttatgagagaaagggtatcttctccttgaatgattcagatagcctttaaaaagttaaaatctgaatcaggccttgaagaagagttaggatttgaaagggtgaaggtgtaagtaaactgcacgagcagaagtagataacagaaaacacaaggcatcttcaaagaatggtgaataatccagtttgggttaaataatgtaggcagagtatttatataaatacgatttgaactgtattcaaatagtagtatttgctgaactgttttctgaatagttttcattacgtggcctgtagctggcttccttagtgccaaaagtttactcagcatattataatccttggaaaatgaagcagaaactgcatgaaaagagatttttattttcacactccttcaacacctaaggctttctcactttgtgttacaactaaattggttgactaatgtcatgtaatctgagaaatacactgtacttcgttctagtagatatttaaggtccctttaggactgaaacttacagaaatcagattccaggaattatccaatctcattttgatttcggataaacattaatttgccttattccttaaatatggtgaattcattatgaagtctttggcatacttttaaagatggaagtacaatattgcaatattatacatatactttgtgtgccatgggtcatctatgcacagtaagatgaagcatgatattaatgacatctatttagtcacaaagaaaatttaaaatatcacctgaatgttcagtttttcccccaagtttaatcagacttgagagtttaaattaaaaataaattgtgttgtaggttctagtcacccaataacttatcggatccaggcttaattattgtttaatgttgcaaatttagcgcagaataattctttgagtaaagatcaagaaataattaaatatgatttgaaaaagtacaaagtccaggcccggcacggtggctcacacctataatcccagcactttgggaggccaaggcgggtggatcacctgaggtcagtcaggagtttgagaccagcctggccaaaatggtaaaaccctgtctccactaaaaataacaaaaaattaggcgggtgtggtggcaggtgcctgtaatcccagctactcaggaggctgaggcaggagaatcacttgaacccgggaggtagaggttgcaatgagccaagattgtgccattacagtccagcctgggcaacaagaccgaaacgctgtctctttaaaaaaaaaaaaaaaaaaaaaaagtgcaaagtcctatgtattcttcagagttgttaggaaagaaaacaaataaggttagctacatatttagctaaccttagatttaataaactattaagttatttaggtcaaaaagaataactaaatggatgctacaaatttcaaccagtattttcgattttttgaggtctatcatctgaaccctcagtggcaaacaatacgaaaattcaacatatttttatttgttaaatatatgaatataattaaatatattccttcagtaaactgaactggacaaaactagagaacagaccttttccatactcatttaactttaaaatgatattactttgaattctactacataccatcttagatcctgttttgaaattccattcacattacattcgatttactagaatgcctttttttttcttttttgagatggggtctcactctgttgctcagcaggaatgcagtggtacaatcacgactcactatacccttgaacttctgggctcaggggatcctcttgcctctgcagcctaataatttttttttaatttttatttttttgtagagttggggatcttgccttgctaaccaggctggtctcaaacttgtggcttcacgcaatccccacacctcagccttccaaagtgctgggattacaggtgtaagccaccatgcctgatctggaatgctttctaaaaatatggcattataaacataatactaaagagaaaaaaaggttaaatttcacttcaagaaattatcagtctaatagcatcagtaaaaatggcacttttagtcatggcataaaatatacaataaggctatttttcaattattgttttcaagttggaaaatgcattatgaaacactcaaaaagatgctactgggtttactcatcaagtgcttttgacaccatataaatgacagagtaacaccacagttatgtgattgggactcaagaatccttaaatgttaggactgaaaacaggtatatgacttatttgtccagaatttatatttttctgtatcccaataaaataattaagccatgtgtattgtgtaaaattacagtctttcagtctgtcctatgtgcttgctctcctggctagatattagctaaaaattagcaaaaacagccatttcccctattattccccagcaaagatgtgaaaccaaaacgcctaaccttttctgcctggtggactgccctctactggactatttgaggtattcagccagcaggtcaatgtgactaaaaaggtaaacatagagataaatgtaaacattaaaaaaaaaggaaccctttagtatattaacttttaccatgaaaacaatttcagtcattttgagaactgacaatgaagatgtttatacagtcttagtctccttttcaaccttggaggcagatctgcagcaataatagtaacaagtaggagcaatgggtgtactatcatgaccatcttttatgatgactggtgcattaatacaaatcacatttttctgagtccattcatgctatggatgttttcttatgcataaacatagagtagacacatactaaatagatcacatctgttaagtctcttgccacaagcatcaaaacttttcagagctgtctcttccgtgaaaatccatttcatgtagtagcaagttgattttctttgtggttcatccccacgcctgagacttgcagtaatgtaaaaccagtttaccatcactgccaaaacactacaaaaaaaaaaggcaataaatcaaactcaatcttttattattcttagatgaaactaagaagataaatgccacatgtatcataaatatccacacacgtatattaagttacctatgttacaggctatctctttcaaaggatgcctgtttctatcagacacatattaataatcctaagtgtttaataaaatctgtcctttaagcatcttaggcatgaatgagcttatgtattttaatcttgtcctttctctacatgtccaaccacaatatatgtaattttagctgttttctagtagtggtgctagtatgtgtactctaataactattacaatgactctgtaagatgttaaacagtcattcttatgctgttttctcaatttcttgtaggcagatttggataacagattataagaacaatgtagaagaaatcaaatgtagataaagaaaaagccttactttatgagaatcatgaagatgactttgaaatgtaatttattccttggttcttcaatcattgtataatttattaatatctttctatgatcaagatgttagataacagaacaagaaagtcatcttttctaccccagaaaattaagaatggcatgccatctcttgaaataaaaatgtgaattaacaatactacacaatatacatattatacagatgtgcatactcgattaagaaaaaaaagcagtaatttctttcttttttttttttttttttttttttttttacctcatagagagttccaacttcttggtctggggaaggagcaaaggactgattcacataaataaactacaagaaaggaaggaaaaacagagatgtttaatggtatcctgattaatctgcatttttctgcattccaatcagctagctattttgtattgttttcacaattgaagaaagcttctctgaactcctaacttttctaaatagtcaatttaaagagatcattacgaagatctcatttttcctccagaggaataaaaataacacaattccagttcctagaacagtggttcctaactttgtataactaagaaacttttaaatattttttacaaatagcttttgaagagctggctattcaagaaattacattatcgtaaaaatgtccccacttacccacaaagaatttctcctaagataattacacaggcacacagccaaaaatcaatatgtctaatattcaaggtagtttgtacactttccttgggtaaatgtatgacatatatacttaggttttttaataaagtcacttacaggcaaatgaagcaggaaaaaaagtaacaattaaaaccttataaccttgctctttaaaggattcactgctcaatgtttcagtttagtctgtttttactaaaatatttctagtacttaaagtcacagtgttgaagtgccctttaataattttctttttggaaaacaaaactttatttgcaggtaacatatttagttttcctttaatatccaaatttgggactaaaatgtcctggattaaacttagtatttaaaaaaaaaagtatcagaatagttggttgacagatactattttgatcaccaaccatgaaccatcaatattgcttgcatctctcttagccaatatagtgtggtgattaagtgtataggctctgagacacacctgggtttgaatcctggctttacaaataatctctcatcctctttatttgtaagatatggaaaataataggacctatacctcttgggtctgttaggaaagacaaaatgagataatacactaactttcagtgcctggtatatgtactcaatagacgttattgttaaattatctttaaatagttcatgctgaaatatcaatttgtggttatggctgagtagagttctggcacaaaaatttcagaactgtaacagaaaacaatgtgcattataatgtgaattttttgtaatacagatataatttgtgttcagtgcctgacaatttatgagcaaatccagattttactcttgtacattataaatgaggggaagggctctcaataacagcttagtttatcagtgtctatgatgtgctgagaattgtacatggaactatgaagattaatgtgatctcttccctcaatgagcttataatctgtaggagaggcagagacacacatgaataaatacgggtgagaaaagtacatctaatgaagtatgtagcgtacagaaatgtacactactctagcctagcaaaagggtcagtgatggctttgtgggaaataagaaataagcaggatttaaccaggtgaagaaagcagtaatcaggacttcacaggcaaaggagacaaagagtaagatggtgttgtgttcacagaaaacagcagactcgatggagcagagaaccaaccaaaggcattcaatgtgattttgtaacaggtgttaactggaaattttaaaaaagcaattcagttagttcaaaagacagaaagacataaatctgtttgcatactataaagctctatataagtaacaggttaacatcatcaattccactgcagaatcgctaagtggcgtataatttgttactttaaagtacatgtagttactccaggtttgtgaaagtaaaattccatggaagtattatttccaaactgcaagaacttgggcagacaaaattagttagttttattaattactttgcctttaaatcagcttttttttctttctgcttttaaatcagcagtctttaaattgatgtctctagttattctggttataaagctctctgtctagtggattcctcatggttcactggaatagcattttctgctaatagtctgtgccccgattaagtcagttatgcaggatatgaaagccttatttcacactttttccttaagcatctttgctgtcaaagtttgacgacagcctaactttctaagtcatgccctctttcccgtcccctacatttccaaatgatttcaagtccagtaattttaacagaatgcatcctgatgttcattattctgggttgatactctcaggtacttcagatgttttttcaatatgtagtttcaaatctcttaccttaaatgacatttttacagtattttttctgttcccttgctctggttttcttcacagactcttgtccaaaggttgactcactttttaaatttttttcatcttctatttttcttaacatattatccgttgtttatgttcctcctactttagtctccatttctgaaataattttcttttatttctaattcttttcctgagcttcatttcttagttttactaatgctgatcgtttttctttcatgtcttataccatcttattgtttttagctcattttgaaatacaaggttacaattttcgacttgtcttataggtgtatatttctggcttgatttcatcgtctctagggatgctgttcttttccgcatctcgtttttcttgtaacactgtacgggatttgaccttgttattcctgttattgtttttatgtgaaattagttttcctcaacttttagaatgaggtgaattagggtagtttttctaacttcacagagctccccttgttgttttttgtatactattcaaaacgatggaggcctgctttgagctttccaggctctgttccccaccattttgatctggtctttctctttccttcctttctcatgtccctacccttttcaattttcatttcacttcctgaaatttctcctcagtatggggtcccagagccctcctgggtccattttgagattgtttgagcccttcaagtccttagtgcaaatgtattgtcatcacgtgctacagaagagggcaaaactccttagtcagcttctattcttaaattggctcactttacttcccggtcaggatctattagcgtttttgaggttctacttttctcagtgccgtcagatgccaaccctgtttcttactgcttctttcagcacagatgctgataccatgcaggtcctgtggttgctggtggtttgtccccaccaacatgtgttttggggctcatggggataccttatcacctagttttgttacaaatactaatcaggggtttttggttttgctatctagttgactaagttttgtgagaatttcagagagattcacgtgtaccttctgattccaccatcttcccagaattcctagcattactttttttcctttaacatccattttgctagataaaattcaggaggtatcagttttagtttaatctaggaaaatgacaaaataattcttatgtttcctattgcttaaatgggaaaggataatcatattcactacagaggatttaatttaacccttatgaaattgttttcatagggtaaaatggctgaatgatggcaattttatatggttcaacctactatgtattggtatcaatcaagtcctttcaggttactgaatgaatacaggcaatacaaaatttcaagactcttaacacagaacacagtatcatttcatttttcttaaatctccatgtatttctaaactaatgcattaaattactcagtactcttattttaccaactcttcatgttgcatctttagcaaagatgcagcctctgctcatttctctcaagtgtatgtcctcattcccctgacttttccatttagcttcacttttgtgagagcacttgcagccaaactcttagatcagagtcagttttttgctcctccctgacaaaaagaaattccaacatgtcctgctttaatgatagttcacttgttttacccatgcacacgcctgtgttcagaagcaaatatttcccccagtgcccccaaaaattcctgattttatttaaaaaatacttagcaattcttcaattacctatccactcatgctatctgagttaatactatccaagattgtgatctatttgcagataaaggtgtctcatacatataattatgtatatataaaaaacacttaatgtgccaaatacatgtagacatttaaatttctgtagtcaaatgccaaattaaaatgcagtggcatttaaagaattaacctttactacaactgccactgtgaagtgcttaacgtgtactgttaacatgaagtatttcctagttctttcacaatatatggcaaagatacattgcttacctcaagaaaaataggaaaaaagtaactgctatcaaaacaaactgaaaaaatccaaaacttctgtagtaatgtacagatattgcaatgctctatgatagatttttatgcatgggtattcatgcatactttcatgtgactttctgaggaaaacaatacaggaggcaaaaaataaatacataaactggttcacattgtaaaacaaatctaaaacatttcatttcagaattccccagagaatcctttgataaagtacataaactccactaacaagagataaggcagggcacagtggcacactcatgtaattctagcacttctgaggcggccccgtctctactaaaaacacaaaaattagccaggcttggtggtgcactcctgtaataatcctggctactagggtggctgaggcaggagaatcgcttgaaccaggaggagaaggttgcagtgtgtcactgcactccagcctgggcaacagagcgagactgtctcaaaaaaaaaaaatgaataaataaaaataaagggataaaagggcataacaaaagcgacatatgtggctccatatgcatttctataaacaacagttaattcactgttgcctaggaactactgcaaatttttgtaggaaaacatcaccattggtttcataccaactgttctgaggccacaagtttaagaaactttttgatgaagtcaatgagtccttggatggttcgtgttcgctctactgcccacttctttgttttcataataggagtgtctcccacagcctttagcaaaatgtcaactgtaaaagaagaataaaatttactgacaattacactgaaacatctaaagagaatggaatataaaagacttagaaatcagaaatatttaatctacatccatcttacgtatttatgatactgaagatatgtgagagatgtaaaaatgttagattcttttccatcatttttttcttgatcctacaaagttctcccaacaggactaatttttaaaatgccttttatcttaacaggcagttccaaagagaggaaatacaaatgatcaatacacaaacaatatttaagttcacaaaaagcaaagtaaaataatgtcatgtcccttttcacccaccaaactagttaaaattagagtaattaccagtgtagatgatactacttttgagaatgtaaaatggtataccctttgtggaatgcagtatggtaatacagatcctaataaaggtatactttgattcaataatacttctaggaatccagtgtaagaaaatatgagatgtgtgaaaattcacttaaaaagatttcacctccatttaagcatttatttttatatgaaacactggtaaacctaaatacccaaaaaggatatttggaggtgactgattaaatagaatgtagtaaaccgcatacacttttaactgcctggggttcgaatcctggctctgccacttgctgggtatatatgtggatatttaatctctccaacagcatgtataatatcttaaattcattaaaaaccatcacaaacacattcacataaatatggaagaatatgcaacaaaatgatatttctcagtagtgacattgtaggcaatgattacttggatttacttatgctgtttgtaactaccaaattttctgtaataaactttttaataaaggaaagcaataagttattaacaatagaacaaccaaagccaaaaagaagttgcagaaagagaaatcttaaggtttcaacgatccaaaacacagatatgcaaacccaaaccctatgaatctgtctctcagacataaagttatttgctaaaacaaaacaaacatacatctggctgggcgcggtggctcacgccagtaatctccacactttgggaggctgaggcaggaggatcacttgaggtcaggagttcaagagggcccagtccccttccaacttcttgttcacgaccagcctggccaacatggtgaaaccccatctctactaaaaatacaaaaacttagccaggcgtggtggtgcatgcccgtaatctcagctacttgggaggctgagacaggggaatagcttgaacccgggacgcggaggttgcagtgaaccgagattaagccactgcactccagcctgggtgacagactgagacatcctctcaaaaaaaaaaaaaaaaaaatctacagtcaaaaagcaagacacattgaaagcaaaacagtgtattgctgccccctaaagttaactctattctattacacccttcttgctccattctttaggtattaaatattggggccaaaagatcagaggtcattttattcaagtttactcctggaatgaacgcatctagaacacatgatctttatcttcctactaaagaactacttaattatcctaggtccagttatcttaggaataggaatgaatttggagataacgtgggattttagttagcctatctttcatacctcctttcactgctccctcaaatcccctggggctatcaataaatcgattaattcaattaaacatttccagaaagtgaagcaggaaatatcatgagttatgctaccaaggatgaagtgtaagacagtgagaaaccagagaaggaaaataatttaattatagctgccctctctttttaattttaaaggtgatttgcttgtagttctgaacccggatacacattagaatcaactagggaaacacttactccccaggaaacctaacatacctccagtgccaaaaccttggtctgtttcaacaatctttcttctgtagattaacaaaggctgaggatacaaaacagttaagctgctttcatcatattatcctcaacaaataatgacaagcacaaggtaggaatagttagaaactaagttttatattggagaggcaaactcaaatgctaacaagagccagaaaataaaaatctcatccttaaatgacagttcaatttgcaaaaaaatactgtccagaccaagaaaatatgccctcgggcaatatttagattgtaagccattttttttagcttttgttttgcacagctatcatcagagtcaagtaacaagttttgactaagactgttagaccttaaaacgaatctccgaacgtccgctcttgcctatagtaaattggaagaaaaaatgcaacaaaacactgtaaaacctgcggaattcttttgaagaaagattccagtggctatccatggaaatacttatagtgcatcaggtggaaatgggagtctgatttaaagtgggaaggggggcagtcttgggagagaattatcctccacagtagcagaagttgaagaaaaagcaatgagaccaatgtcttttttttttttttttttgaggcggagtttcgctcttgttgtccaggctggagtgcaatggcgagacctccgcccactgccacctccgcctcgcgggttcaagcgattctcctgcctcagcctcccgagtagctgggattacaggcgcgcgccaccacacccatctaacttttatatttttagtagagatggagtcttaccatgttggccaggctggtctcgaactcttgacctcaggtgatccacccgcctcagcctaccaaagtgctgggattacaggagtgagccaccgcgcccggccagagaccactgtcatcttaagacagaacggggaaaacgtctaaggacgaaatcagcctctctgaatcgaggatgcttatatgctgcttttcccataggcaactctaactctaaacagagtgctttagaacacgtaattttagcaatctcttttacaaagggaaacattctcaagcaataaagggttgaggatagctgactcaagcaatgaaataactcacaaaggttccaaaatgtgtttcttaaaaaggtaacatctatgcctttagctttcccttagcagtcttcattctgcataagaatttggtttttggtttaaggagtgaattcacaaccaactgggagggggaaaaaagcaaaagcgagttaagttggaaggcatgaattctaatccaggctttgccaatgaccacccctaccaccataaaacattactcaaataattagctcctgtgttaagtacctggaattaccgagacccccctccccccgccccactcagctccctccctccttcaaagagctcgcagtctggccaactcaaaaaaatacagtataaaaataagtgtggcagccaagtatcaggccctacaccgatagacagagatggtattttaacactcaacttaaaggccttaaaaatcaaaaagtacacttcttttcttctgatgactggtcaaaatgcaggtctaggacaggcgctcctctaaattttgcttctttactggccgccacccctactcggatgcaatctgaacctcccgcctctctgcccggaaataaattcagttactttttttcttggtgtcgccagcaggttcctctgttcccggggaaactgcagcggaagacgggggctccggggtggttgtttctggggagacatccgtaagtccttcccctccagcagcaattgaagtaggaagctgcaacacagactgcggctcctccgccatcttgcttggagacactcgagagcggaagtagcgactgagcgcgtgcagtgggcgtgcttttctcca

SEQ ID NO: 4 - DNA, 26339 bp, Homo Sapiens
tcgaacactgtgttgaataggagtggtgagagagggcatccctgtcttgtgccagttttcaaagggaatgcttccagtttttgcccattcagtatgatattggctgtgggtttgtcataaatagctcttattattttgagatatgttccatcaatacctagtttattgagagtttttagcatgaagggctgttgaattttgtcgaaggccttttctgcatgtattgagataatcatgtggtttttgtctttgtttctgtttatgtgatggattacatttattgatttgtgtatgttgaaccagccttgcatcccagggataaagccaacttgatcttgatggattgttcttttttttttttttctaaattttttgtagagacgagagctcactatcttgcccaggccagtctggagctcctgagctcaagggaatccttctgccttagtctcccagagtgctaggattacaggcttgagccatcatgcccagcatctttcttttcttttctttcttcttttcctttcctttcctttcctttcctcttattttctcttttcctttattttccttccttcctctctctctctctcttttttttttttttctgagacagagtttcactcagtcaccgaggctggagtgcagtggtgtgatctcagctcactgcaatctcggcctcctgggttcaaatgattttcctgccttagcttcccaagtagctgggattacaggtgcacactaccatgcccagctaattttttgtattttttagtagagacggggtttcaccatgttggccaggctggtctcgaactcctgacctcgagtgattcgcccgccttggcctcccaaagtgctgggattataggtgtgagccaaccacgcccagcccttcctttctttcttatttccatgtttattttggattcaaggggtacatgtacaggtttgttacaagggttgatttcgtgatgctgagatttgggcttctattgattctgtcatccagatagtgaacataatattcagtgggaagtttttcagtccttgacctgctcccttcctcatttttgagtccctagtgtttatttttctcatctttatgtctgtacgtacccaagatttagctgccacttataagtgagaacatgtgatatttggttttcagtttctacgttaattcgcttaggataatggcctccatctgcatccacgttgctgcaaagaatgtgacttcattttttatggctgcatagtattccatcgtgtatatgtaccacattttctttatccaatgcaccgttgatgggcacctagggtgagtccatgtctttgctattgtgaatagtgctgcaatgaacatgagagtgcacgtgtcttttgttagaacaatttactttctttgggtatatacccagtaatgacattgctgggtcgaatggtggttctatttttaacactacttttttttctattttacaattgaggagcctctttgagttctaatgtttatatattcttaagtagaatgcttcatttattcacagaatatacaatggaaattatccagctattgttcaacaggtagttcctgattcaatatgttctgagaacaactcttacatcactagtacagagattaaagatgtggctccacaattttgattttcttccaaaagagtaaatcttaaagtctgtgacactgcctgtttaattaaaagggagtaactagtacttacagctttgcaatggagcccttcataagggaaatcagtgtctaggttgtgaacaaagtttactggttagcatgtttccgatgttcttggatgttttctagtatctatcacaaacactaacagcatttgttctaacatctgctttaaaacaggtactatataagaccaaaaaattcccatgtctacttatggaggacagtctttgaatatcttttaaatgatagagatcatgtactctatatgaataggctatagaataaaacattttagtttttatcagttatcaaattcaggatttttcttttcaattatagattgtaagagggtagtaatatgtacattttaaaaaacatatataggtgcatatgtatgtgtgtgagtatatatatatatatatacttaacaacgagtgaggtccatgaaattgggttatgggttggtagtcacaactccacctgtagcacccctttaccacacaaatgtcaaaacgggatcacagtgtggaaacagaagagtgcaggatatattagaatctgaaatctttctcaaggatatgaggtgcctggtagaactttatttacatgttaggaaattttaacatgagcttttcaagaaatggaattgaaaagtccagaggaagaggtgagtttataactattaagcatactgaaacaaatgaggtttggaattttgcactaagtttgttaagctttactgtgtttttgctatggggggaacttggatttttctttttttttcattttatcctctgtccttaatatttttaatatttggagtggtaattactgaaaattggagagggacatagagtgacttagggagggcaaagggaggttttttttttgtttttgttttttgaaagttctaaaacctgaaaattattctggagtcttccgaaaatgttcagacacatttaagaatttttattgagtaatacaatgttctaattgaggcatacacgttgttctaggagtctgtgaaattctaaagataaaagtttgattatgcttgttttgactttaatgaactattcacataattttaatacacagtgtctaacacgtatgaaagttgtgtaataccttataccttaacaatggagaattactaagcaattttggctactctgatattagcatttcctgaaactcctcaggctgatgtggcaaaggagaaatagcaatcttgagttctgaaaagctaggccgcattttggtcctgaaaaatcacttgctgtgaacttgggccagtttttgattttttaaatggcataacagttcgttgctacaagaggttacatcaggaaaatttcctaaggatttaagattttgttcatctattgagttcttttgggtgatttgtttaggaggaagtatctgctcctttttgagttgcttcaccaaagtacttgagtgagaaggcagaatataatgagaatgatcatgctggcaaggaagacatatatatgagatgggttatcctttacacctacgtcagctaaaaccgtctcctacgaacaaatccagcacttggcactttattcgacggtcctaaaaatagagtcctaaatttagaaggcaaggtgctacttttagctcctcttctcggaggaaaacagcacgcaccgcgccaggccaaggtccacggggatttgatttagcatttgggtaactggccgctaatggaactgaagacagctgggcctaacaagtgcccaggtgactcaggtaagcgaggaaaccagatcgaggttctcttgcgtgggacaggttaaactctgaccaaaccacagctgagccgggacgccttcctgtctaaagtccaaagtccggacgtggttggcagggcgcaccggcgcgtgccccgcaggccatttttctgactggaatgacggcggcggctggcttctcggggctgccggggtctcccggggtacgccgccgtcaggacttctgcagggcgcagacagcaggctccagcgaggctgcggaaggaaagccttgggtgtcggggctgggcctggcgtcggcccctgggtcgggggggtgggggttgcgccgagacgcctctaggagaagtctcgccgccgccgccaccgcggccgcccgaggcgggtgcccttgggacatagccctggtctttggggttgtgcggctcacacgacagcgcggagtatgaggccgaatctcatcctctagtcccaagcctctccactaccagggctgggtggcttcgccaggtagagcgccggcccctttaagagcaaacgacccggacacgtctgcgaagcttgcgcgaagaaggggaagtttgcggctgtccgcgcctccccgccttctcgcggctgcccggccgaaaccaaaccgaggggtggggtggcgaggacagggtacgtcgcaggcttgtgcgggtcgggctcggacctgcgctgcctcgggatgtaaagtataacaagagggtcgggatgggcagcgtaggcctgtgaggcctgcgggtgcccctgtcccccagctccccccgcagccggctccgcagtggtccactccggttgccgggtgcggattcgggttccggaccgaaggctgtgtgttctccgccgtttattgtggccccgacaggccggggttactgtggcgaccacgagagcagctttggcgctatggaggagcccggggttacccctcaaccgtatttggggctgctcctggaggagctacgcagggtgagcccaggcgcgatgagtgttacgtggcccaggggtcgcgggagccgccgggggaaggaagcagtagaccggctttggggtctaagccgccgtggtcagaggtcccgaagccagtcctcgtctgctgcccggctcccgcccgtgttcgaggcagtagttaggctcgtagggcgcttgagtggtttttgtgtgatggaggaggacctggggctctgggaaggtgaagaaagcacttgcttagctggactttgcaaagatgtaaatgtttcccgattcctaaaactaattagcctttccgctatgttgtttattttgagcagagacacgtggttccttcgactgtgagaaacttgaggactgttcctttaaattagttacatttactgatgtaacttctcgttgaaccttgaaagaacacctgaggttgggcggggagttgaaattttgattctgcattttttttttttttggtaaagaatgaatgcccttttgagatgctctaccatgagtgagattgttcttcgcttctgtcttgttaatgtacagtctagagatagtaaactcccagtgttcaaattttgttttttatttttcaggtctagtttataatcaagttgtagagatttttctccttaagtgtttctaggtatctttgttgacatgtgtaggggcatttatgtcgccgtgtttttaaaaactggattaaatctttaaaaagaccacttaattattgaggcagttacgattatgttttcttgttaggtgaattaaaggtagtgttgccatggtgtttatgagttcatagtttgtctaatgcatacgcatatatatgtatttaatatgaaaagagcacctttatggagattctaaatggactaagacttagttttggccactagcatcatgttgtctgttaagagagagaagacaaaaaaaaaaatagtacaaagtagaaactgatgaagtgcttacctaagcatacacacacagtgcagggaactaggagctgtattacttagagtgtaaagtgggcttagggagtgatgggcaatgatgcttgccggagatgtaagtaggttccaagtgctgtaggtgttggagagctcttgaaggcttttccgtggttagacttgtggtttaaaatttaagctcttcttgatagtagcatgtagattagatgttagggaaacaaaacttgaaatagggattaagggagaggtgacagtagtaaggataggaaagagggtactgtgtggagaaatagcctctaagagctaaaatatgtttgactttattgattgcatgtgaagggtgagagagaaggaatctagaaggactcccaggtttctggctgtggtaacttattcatggaggtagggtttttagaaagagaagcatatttccctttcttcactaaaaacaataataatcaagatttagtttttataggactgccagtgtacatggagaaatgcagaaatacatggagaaatgcagccagattttgcagttttctctagtctggtgcgttgtatcttcacctgcacagtttttttttttttttttttttttttgctaaatgcgagtaccctggcctgggggctaggatggcacaacattgttccgctttaaattttttttttatttttaaaaattattttgtattgagatatattcacacaacataaaattcatccttttataatgtccatttcagtgctttttttgttaaattcactatgttatgcaactgtcagcacagttcctcaacatttttattaccccagaaaataaactctactgattagcagtcttaattcccacccctcatcccttgacaaccactaatctattttctgtctctatgaacatgtctattctgcatgtgtcatgtagtcatgctatatgtggccttttgtctggcttcttttacttagcatgttttcaaggcttatccatgttgtagcatgtaacagagcttcatttcttttttctttctttttttttttttgagacagggtctcatccctgtcacccaggggggagtgcagtggcttgatctcagctcactgcagcttagacctctctggctcaggtgatcctcccacctcagcctcctgaataggtgggaccacagcacatgccaccaggcctggctaatttttttgtattttttgtagagacagggtttctccatgttacccaggctggtcttgagctcctaggctcaagtgatctgcccacctaggcctccaaaaatgctgggattacaggcgtgagccacttcgcctggcccttcatttctttttatggtgaaaaaatattccgttgtgtgactatatcacatttatgtcatagttgatggacatatggattattaatactttttggctattatgaataatgctgctttgtgtataagtttttatatatgtttttagttctcctgggtaagtacctgggtggaatcgctgagtcatatttaccatatgtttaactttttgagaactgccaaattgttttccagaggtcacaccattttacatccccaccagcagtttatgagggtttcagttttctgcattctctccaacgcttgtgattttctgttttcttttgtttttaattgccacccttgtgggtgtacaggtgagtggtatttcactctgttgtggtttttttttttttttttttgagactgagtcttgctctgtcacccaggctggagtgcagtggcatgatctcggctcactgcagcctccacctcccaggttcaagtgattctcctgcctcagcctcctgtgtagctgggactataggcactaaccaccacacctggctgatttttgtatttttagtagagacaggtttcaccatgttggccaggatgatctcgatctcctgaccttgtgatccacccgcctcggcctcccaaagtgcagggattacaggtgtgagtccccccacccggctttactctgttttttgttgttgttgttgtttgtttgttttgttttttaagagatggggtcttgctttgttgcccaggctggagcgtagtggcgtgatcatagcccactgctgccttaaattcctggcctcaagggatcctcctgcctcagccttccagagtgctggtgttacagatgtgagccaccacaccaggccttgtggttgttttgatttgtattttcctagtaactaatgatgttgagcatgtgcttattgtttatatcttctttggggaaatgtctattgatttccttttgctcatttaaaaaatgggtggtctttttattgttgagttataagcattctttatacatttagggtgctaaatgcttaccagataaatgatttagaaagattttctctcattctgtgcattttcttttcaccttcttggtgtgtcctttgaagcgtaagcgttctaaattttgattaagtctaatttatcttttcttcctttggttgcttgtgcttttggtatcatagctaagaaaccgttgcttaagacaaggttacaaacatttacagttatgcttccttctaagagttttagctcttacgggaagttcttcgatccactttgagtgattttgtttccatatatgttatgaagaatgggtctagattcattccttggcatgtggatatttattggcttattctagtatgatttgtttgaaagaactgtttttttctcattgatttgtcttaatactgttgaaaataatttaccataaatttaagggtttatttctggactctgatttctatttcattggtctgtgtctgtccctatgccattactacattatctttaaaacatttttttacccaatgtcttgattattgtttctttgtagtaagatacagtagggaagtatgagtcccccagcgttgtttttgtttatccacgttctttttctttatcaatattgttttggctatgtggagtcccttgcatttctatataaattttaggaattcagttttaggaatttaggattcagtttgtccatttctgcaaaaaaggcagttggaattttaataggggttgcattgagtctgttgatcagtttagggagtattgctctcttaataatattaagtcttccaagctgggtgcagtggttcatgcttgtaatcccagcactttgggagaccaaggtgagcagatcatttgagcccaggacttcaagaccagcccgggcaacttggtgaaactgttgtggtctttctgctccttagctcagctaggtccaagttcttgtctcacaaccaagaagaattaggcatgcggaccccagagagtgagtggaatagaatttattaagtgaaaggaaagctctcagcaaagagggaatgcagggggtggttcccctaccagaaggcaggaaagtccccctgtgtggctgggtctgcggccttttgtggactcagaatggggagtgcatgctgattggtttgtgagtatgcaaaaaaggttaaagcaaagacaccacttagaggtgggcgtgacaatgtagacaactaattaggaggccgggtgcggtggctcatgcctgtaatcccagcactttgggaggctgatgggggtggatcacgaggtcaggagtttgagaccagcctggccaacatggtgaaacccttctctactaaagatacaaaaaattagctgagcatggtggtgtgcgtctgtaatcccagctactcaggaggctgaggcaggagaatcgcttgaacccgggaggcggaggttgccgtgagctgagattgcgccattgcactccatcctgggtgacagggcgagactccatcccaaaaaaaagaaaaagaaaacttattagtaaagggtaggtatatgtaaaataggtgaaagatggggatcaatcagaggaaagtgggccaaacaagaaggcaagttctcaatctggtccaaggatttaacttgtggcttggctttcaggctttaaactgtctttggcttgaagttggggtttcactagggacccgcccctatctgcctgggcatttggctgcctcctgccactctcaaaatcctgtctttaaaagaaatacaaaaattagttgggcaaggtggcatgtgcctgtagtcctgctgcttgaggctgaggtgggaggatcatctgagcctggggagggcaaggctgcagtgagccaagatcgcaccactgcactccagcctgggtgacagactcagtccctgtttcaaacaaagaagtcttccagcccatggacgtggattggctttacatttatttaagtcttccttcgttgctttccacaatattttgtagtttcagtgtgcacttcttttgttaaatgtattcctaataatcttattctttttgatgctattatagatggaaatgttttctttatttcattttcaggttgctcattgctgttgtatagaaattcaactgatttttctatgttgattttgtattctgcaactttgctgaacttaatagctctgatagtttttctataggttctttaggattttctctgtgtatagaatagcattatgtcatcttcaaacagtttttcttcttcctttccagtctggatgccttttatttatttttctttcctaattgctctggctagaacctccattacaatgttgaatacatgttgatagagcggacattattgttcctgatcttaggagaaaagctttttttttttttttttcctcatctttaagtatgatgttaactgtaggttttgcatagatgtttcttgtcaggttgaggaaattccctcaaatcgtactttgttgagtgtgttttgttttttttgttgtttgtttgggacagggcctcactctgttgcccaggctggagtgcagtggcatgatcatgattcactgccgtctcgacttcctgggcacaggtgattctcccacctcggccttctgagtagctgggaccacaggcatgtgccatcatgcttggctaatttttgttgaatgttttgactatgaaacggtgctagatatagtcaaatgctttttctgtgtctattgagatgatcatgcgttttttttttctcttcattttcttaatatggttcataagattattgtatgttaaaccaaccttgcatttctgggataaatcccacttggtcatggtacataatcctttttatatgttgctggatttggtttgtcaatatttttttgaggatttttgcatctggagtcataagatatattggtgtgtgattttcttttcttgtgtgatgtatttgtctggcttttagggtaaataccagcctcatagaataagttaggaagtatttcttcctcctctatgtttgggaagagtttgagagtgattggtgttaatgttttatcttggagaggtgtaccttcatggaactttgtgttatagtcaagtattcacagggtctgcatgttgacattctttttgttattagtatatatcatgtttgaagttagatgaaaaacaattttagtttattcttagtatattttgtcaacctgattaattgattttttttaaagctacttgatcttgaactcctttagtactcatgttttggaaatggaatagattttaagtgttctgtgattaatcactaccgtactttatggagggttactcttggaggggttacccatcaccctttaaatttcagtttatcagattacatgtaattctgtattatatttgttgatatttgagaaatttggttgttctttctatgtttttgtgagatagggtgttatgttgtagataaaatttaagggtgaaaaatctccttgagaaagccagaataatttagaccagagcaatgaatttgagatgaatcctttagaactcagtttctttttttctttttttctttttttttttttttgagatggagtctcactctgtcacccaggctggagtgcagtggcgtgttcttggctcactgtagcctcctcccgggttcaggcaattcttgtatctcagcctcccaagtagctgggattacaggcttacgccaccatgcccagctaatttttgtatttttggtagagatggggtttcaccacgttggccagactggtctcaaactcctgacctcaagtgatctgcccaccttggcctcccaaagtgctgggattacaggcctgagccaccgtgcgtggccaagactcagattctttgcttttctccagtctgccagatctaaccagctcaaggctttattttattttatttttttaaagttttttttttttgtaatcccagcactttgggaggccaaggcaggtggatcacctgaggtcaggagtttgagaccagtctggccaacatggtgaaaccctgtctctactaaaaatataaaaactagccgggcatggtggtgggcacctgtaatcccagctactcgggaggctgaggcaggagaattgcttgaacccaggagacggaggttgcagtaagcctacacggtgccgctgtactccagcctcggcaacagagtgagactccgtctcaaaaaaaaaaaaaaattttttttttttttaaattattccttaatttccatgtttccttaatcctttgtgtgtgtgtgtgtgtgtgtgtgtgtcagagtccagttttgttttgtcacccaggcttgagtgtagtggtgcgatctgcagcctttgcctcccaggttcaagtgattgtcccacctcagcctttctagtagctggaactacaggtgcctgccaccatgcctggctaatttttgtatttttagtagagacagggttttgccacgttggccaggctggtctcaaactcctggcctcatgtgatccgcctacgttggcttcccaaagtgctggcatgagccactgcgcccggccctagctcaatgctttaaactagaatttaccatgtccttttagaagagaagagctgataaaatgtgattgaatctaagaaatattattgtactaaaggtaattacgtgtttgatctgagagatgcttttggaattgccttttaaagtagagtgtcataggtcatattgattacacaatttttgagttagtgtgcgtcttatgtgttgaatacattagctaaaagtaagatgcttggaaaatgtgtaaactgtgaagaaaacttttcttcctggtattgtgtattgaatgccttttttcccccaatagcaaaaataatttttttttatcattaattgcttgtaatgatattagatttctgcgaactggtacctagggtaatgtagggagaggcagaagcagagatcagggtaaagggatattttttagaagtataatcaggtttgtttggtacaggttatgaagtatagatagtaccttggaaggagtacatatttggattagagttataaaagattttggagaggaaaataactattaaacactgttcttataggcagaaagggcctaaaaggaagatttgctgtagaggttttgggttaaagcctgaaaagaatcaaaccccatcatacttcagattgttcttaaaatggcatttttcttttttccccttacctttccccttttctttttgatcaagtaatatcttgggcctggtaacaaagagcagaataaccccattaggtaaggatgagtaatgagctgacccagagaaaggtgaaatatagaagcaacagcaaaagccttaggctgtgttgtgctgaaggtctgctgtggggagaagtaatgtggaaaggccatggtcagaagatcagggtctttggaggagataatataaataattacccttttttgagcacctgtctggcatgttcaaacagcattattctcattacacttaagagaagggacgcacagaggtagggtggggagattcaaactccaaacccaaatctctatcagtggtgttcaaaacttgtttttattttttgagacaggtcttactttgttgcccaggctggctttgaatcaaactttttatttttaaagctgcaaattgattttttcttcctgtagggaaattgtatattggggaactgattatactttacagataaaacctgaactggttgaaatcagggtaagagtacctgaaccctaggtcactcagtttctttctttggccttctcttattctcatccttggaaactttaagtcacctctgtagaactccagtttgaagataattgcatttcaccatactgctgttctttacttggcgatagtgattgaaagttgacaaaaaaatgtactctgatactttctgtttggtgttagtctggcagcccattttgtgttgaccacataaacttgtacctatgtttgtaatcaatatttttaccaaaagtacatttttaagaacttacttttctttatcttgaaggttgtggcagcactgcctgaaggtatgagaccagattctaatctttatggttttccatgggaattggtgatatgtgcagctgttgttggattttttgctgttctcttttttttgtggagaagttttagatcggtaagtaaccagtgctatactaagagaatgttcattttgtcactgggctgaacaaataatatgagaaacatatttgttattttaagtaaacaagttagaaactacatagggattcagaggtttttgttttttgttttttgttttttttaaaagagatgagggtcaggaatgagagtcaggcccagtgctgtggctcccacctctaatcccagcactttgggaggccaaggcagaaagatcacttgagcttaggggtttgtgaccagcctgggcaacacggtgagaccccatcactacaaaaaatacaaaaattagctggacatgaggacacccgtctgtggtcctggctactcaggaggctgaggtgggaggattgcctgatcctgggaagtcgatgctgcagtgagccatggttgtgacactgtactccagcctgggtgacagagagagaccctgtctcaaaaataaagagatgagggtcttgtgttgctcaggctggtctcaaactcctgggctcaagtgatcctcctgcctcggcctcccaaagtcttgggattacaggtttgagccaccatgctcaactggaatcttttaatgtaagatcttttatatatatatatatgtgtgtatatatatatatatatatatatgtgtgtatatatatatatatatatatatgtgtgtatatatatatatatatatatatatatatatatttatatttaaagagatggggtctcactatgttgcctaggttgtagtgcagttgctattcacagatgcaattatagtgcgcctacagcctacagcctcaaactcctgggcttaagcaatcctttctcagccttttgagtagttgggactacacaggtccatgtcactctgcccagcttcatcttttttttaattctgggaaattttatttgagacaggatttcactcctgtcacccgggctggagcgcagtggcatgatctcggctcactgcaatctctgcttcctgtgctgaagcaattctcctgcctcagcctcctgagtagctgggactacaggcgtgcactaccatgcctggctaatttttgtatttttttgtagagacgggtttcactgtgttgctcagaactcctggcctcaagtgatctgcctgccttggtctcccaaagttctgggattataggcattaatcaccacgcctggcctaattttgggaaatttttaatgcatttttgggactgctatttttcagatgttgccccttttacttctgacttccctatctcttaacttctatttttcaatttctttatggttttctataccttttgagagttccttaatctgaggaactgaaatctattcttcatctacactcattgtagagtatcttgtcttttaaaggttttcccttttatctctatccatattctgtagatgattgaagtcctcatttcttttctacttgtttgtgttacctcagccctaaggctgatccttttacaaatgaattcccgcctgcttcattatttgagagagaggttaaggaagaaaaaggtttggtttactgtttctttagtcagttcagatctatggccctatggtaacatttctcaggctgttttattttggatattggcatcaagggatatgataataggggcttcttgaaattatttttttagggtcaaatttgtttggggagcaatgggttaaatgaaattaaacaagtatctttagagtaaagttatttcagagtctttaatatgctaattcacaatgtgaatcttcaatagggagtctttaataagtagtatttaggctgggcatggtggttcatgcctgtaatcccagcactttgggggacccaggcaggtggatcacctgaggtcaggagttccagaccagcctggccaacatggtgaaacccggtctctactaaaaatatgaaaattggctaggcatggtggtgggcacctgtaatcccagctactcaggaggctgaggcagaggaattgcttgaacccaggaggtggaggttgcagtgagctgagatcgcgtcattgcactccagcctgggagacagagcaagactctgtctcaaaaaaaaaaaaaaaaaagcatttattttctcattggaaacagaatacttttggcttgtatttatacaaaggcaataagaaacctgtatttctaagttggcagtagacgttaaatgaattgatttacttgagagcgtatttgttttaatgtaatttttgttaaaaatttgtttcaggttaggagtcggctttatgtgggtaagttcttttttctgctttgactctcattgttgtgttgtaaaaacttataataatttactcatggtaatattgacttgacttttttaggacgagagaaaaagcttgctctaatgctttctggactaattgaagaaaaaagtaaactacttgaaaaatttagccttgttcaaaaagaggtaagatatttttgaaaataatattcatgttagagtcagagaactttatacttctcactgtaggtacttctgtgtaaatttaagattatgaatgctttgtttgcagagtatgagagttctctttgctcttcatattcaacacttaaccagtcttactaattttaaccattgtagtaggtgtacaatggtgtctccttgtgctttccttttgagttttcctgactgatgaggtcgagcacacaaacacatcctctgcatgtgcacatttctggtatctgttcgtgtatccaaatgttctcttttcgtaaagacaccagtcagattggattagggcccaccctaacaaccttattttattttgaccacctccaaaggccttgtctccaaatacagtcacattctgaggtactggggttggagcttcaacatgtgaatttgtggggacacaattcagtccataatagtctttgatccatttgaaatcagatctgtgatggtgcagttgagggtgtgtgtgtgtgtgtgtgaagattcattttttttcctgggcgtgtcgagttaatgccatttattggaaggaccatcttttctctgttgttctgtagtgtcatcttcttaagtcactgaatatatgtgagtctgtttctgttaaatcttctattttgttgggctttttgtttgttttttgccaataacatgctttttatagcctgtagttttataacaagccttagtatctggtatggttaatttacagttcttggctattgtgaataaagttactgtgaacattcttctacaagttttttttttgtgggcatgtattttcatttctcttcataagtagtagtggaattggtaagtcattagggcattagggcaggtatagtttaactgtgtaagataagaaaccggctgggcacggtggctcatgcttgtaatcccagcactttgggaggctgaggcgggcaaatcacgaggtcaggagatcgagactatcctggctaacatggtgaaaccccgtccctactaaaaatacaaaaaaattagccaagtgtggtggtgggtacctgtagtcccagctactcgggaggctgaggcaggagaatggcgtgaaccaggagacggagcttgcagtgagccgagattgtgccactgcactccagcctgggcaacagagtgagactccttctcaaaacaaacaaacaaacaaacaaacaaaaaaaccctactggctgtttttatcattttttcttggttttggctctcagcagtgttactatgatttgtctaggtgtggtttttttctatttgtccttattggggtttatgatgcttctagaatctgtggcttaatgtcttttattagtttagtttttttttttttttttttttttttgagacagcgtctctctctctctcttgtctaggctgcagtacagtggtgtgatcttggctcacttcaatctccacttcctggactcaggtgatcctcccacctcagcctcctgagtagctgggattacaggcatgcgccaccatgtccagctaattttttaaaatttcttgtagagatggggttttgccatgttgtccaggctggtctcgaactcctgggttcaagcaatcctcccgtcttggcttcccaaagtgctaggattacagctgtgagccaccgtgctctaccttttattagttttgaaacactcttgattgttacttttccacatattgtttttgcccttttttgttctttctttctgggactataaaaatgggtattttaactttttattatatctcatctgtctcttacgttcttttccagggtttccatctttttgtttgcccacacttcagtctagacataatcttctttaacttccatgttgccaatagttttcacttatgcctataatcatcttttaaaccatccattgagatcttaatttcatctcttgcctttttcagttctgcagttttattgtggctctttttgtagttctttttctctggtacaattctattttttaattccatttacacattatgctctcttatttttgttttgttttgttttggtttttttttttttttggagacggagtttcccctgttgcccaggctggagtggagtgcagtagcgcgacctcggctcactgcaacctctgcctcccaggttcaagtgattctcctgcctcagcctcccaagtagctgggactacaggcacacgctgccacgcctggctaattttttgtattttagtagggatgggtttcactgtgttgctcaggctggtctcaaactcctgagctcaggcaatccacctgccttggcctcccaaagtgctaggattacaggtgtgagccaccatgcctggcctatgctctcttattttatttatttatgtgttatttttattttctgattttcagaatatatgctgccgacaaatatgctttcttattttaatgactactgcattatccagtagtctatttctggtgctcattttttctcttgtttctcagtcaagtcttgtccgcttgaatgccaggttattttatatgaagtgtcagtgataatataataaaaattgtaaagataattttgaagctgtgggtgctgtcgtctctcttcagtgaggatttactgttgcttttcataggcagctaggctagggacattggaaatttcagataactttatgtatttgactttcttttatgtaaaataagttttattgtgtatatttaaggtatagaaatttcagataactttgattttgttttttgtaaaataagttttattgtatatatttaaggtataaacatgatgagatacgtgtatagtaaatggttactatagtgaaacaaattaacgtattctttctctctcatagttacccattccctgcccacccctccagggcagctataatgtactcatataacaaaaatcatgaatgcagtacactattattaactatggatctcatgttgtacatgagatcttttaacttgttcatcccatatattttcttttcttttattgagacagggtctcattctgtcacacaggctggggtgcagtggcatgatcttggctcattgcagcctctatctcctgggctcaagtaatcctcccacctcagactcctgagtaactgcggctacaggcacatgatacatgcttgcctgatttttaaattttttgtagagatggggtctccctatgttgccaaggatggtctcaaactccctggctcaggtgatcctctcgcctcagcctcccaaattgttgggattacaggcatgagccaccatacccggccatattttctgacctacatgtttcttccctcctacccaacactgctaaccactgttttgttctctatctctatatatttgacctttacaaaaattccgcatataagtgagatcatgcaatatttttctttctatatctggcttattttacttagcaaaatgtcttctaggtccgtccatgttgtagcaaatggcaggatctccacctttttatggctgagtaatattccattgtaaatatataccacagtttctttattcgtttgttcattgatagatacctaggttgtctccatactggctactgtgaataatgctgcagtgaacatgggcatgcagctgtgtgtagaaggtgccaatttcatttttttcggataaatatctggaagaaggtttgctggatatagtagctctattttaaatttctttaggagtctccatactactttctgtagtgactgtacccatctacatccctgccagtagtgtacagtaagccctcaatgtccttgatagatggttgaaaattgactttaagtgaaacagtgtatactgaattcagtttttttttctcatcaatgttataatgaaacaatgttgaagaaaacaatgttattcaaaggacaaaggacctgctctatgcctttctcttttcttgtctagaaaaagggttcccttttttttgtaacttttaagttcaggggtacaagtgcacatttgttacataggtaaacttgcgtcctgggggtttgttgtagagggttcccttttctccacaccttcacaaatacttgtcatctctcttgtctttttgataatagctattctaacagatacaaggtagtatctcattgtgtttttgatttgcatatccttgatgattggtgatattgaacaccatttcatatacctgttggccatttttatgtcatcttcagagaaatatctatttaagtcctttgcctgtttttaaatcaggttgtatgtttgcttgctgttgagttgtatgaggtcttttaaaatattgaatattaaccccttatctgatatattttttctcaatctgtaggttgcctttttattgtgtttacttgtgtatatttttattttttttaccttgcagcttcacctcaaaggaactttcattttattgtttcttttgctttgcaaaagctttttagtttgatgtagtcctgttcacttactttttgcttttgtagcctaagttgttgatgtgatagtcaataaattattgccaaggccagtgtcagggagctttttccctgtgttttcttctaggagttttgtagtttcaggttttatgtttaggtcttttatccactttgagttgatttctatgtgttgtataaagttaagagttcagtttcattcttttgcgtgtgaaatccagttttctcactaccatttattgatgagactattctttctgcattgtatattcttggtgccctattgaaaatttgaccatatttatttggatttatttctgggctctctattctgttccactggtctgtgtatttgtttttatactagtaccacgttgttttcgtgactacagctttggaatataatttaaaatgagttagtctgatgctgccaactctatttttctcagaattgctttgactatttgggatcttttgctattccatattaaatttagattaaaaaaatttctgtgaagaatgccattgagattttggctgcgtttccatttctttgtgtgctcctcaatttctttcatcaatgttttatacttttcagtgtgcagatctttcacctccttggttgaatttgttcctaggtattttattttttttgatgctatgtaaataggattgttttctttttttttcttttttttattttttttttattgatcattcttgggtgtttctcgcagagggggatttggcagggtcataggacaatagtggagggaaggtcagcagataaacaagtgaacaaaggtctctggttttcctaggcagaggaccctgcggtcttccgcagtgtttgtgtccctgggtacttgagattagggagtggtgatgactcttaacgagcatgctgccttcaagcatctgtttagcaaagcacatcttgcaccgcccttaatccattgttaaccctgagtggacacagcacatgtttcagagagcacagggttgggggtaaggtcatagatcaacagcatcccaaggcagaagaatttttcttagtacagaacaaaatgaagtctcccatgtctacttctttctacacatacacagcaacaatctgatttctctatcttttccccacctttcccccttttctattccacaaaaccgccatcgtcatcctggcccgttctcaatgagctgttgggtacacctcccagacggggtggtggctgggcagaagggctcctcacttcccagaaggggcagccgggcagaggcgcccccccacctcccggacggggcggcggccgggcgggggctgccccccacctccctcccggaaggggcggctggccgggcgggggctgacccccccaccttcctcccggacggggcggctggccgggcgggggctgaccccccacctccctcccggacggggcggctggccgggcgggggctgaccccccacctccctcccggacgggatggctggccgggcgggggctgaccccccgacctccctcccggacggggcggctggccgggcgggggctgccccccacctccctcccggatggggtggctggccgggctggggctgaccccccacctccctcccggtcggggtggctgccgggcggagacgctcctcacttcccagacggggcagctgccgggcggaggggctcctcacttctcagacggggcggctgccgggcggaggggctcctcacttctcagatggggcggccgggcagagacgctcctcacctcccagacggggtcgcggccgggcagaggtgctccccacatctcagacgatgggcggccgggcagagatgctcctcacttcctagacgggatggcggccgggaagaggcgctcctcacttcccagactgggcagccgggcagaggggctcctcacatcctagacgatgggcggccaggcagagacgctcttcacttcccagacggggtggcggctgggcagaggctgcaatctcagcactttgggaggccaaggcaggtggctgggaggtggaggttgtagctagccgagatcacaccactgcactccagcctgggcaacgttgagcactgagtgaacgagactccatctgcaatcccggcacctcgggaggccgaggctggcagatcactcttggttaggagctggagaccagcccggccaacacagtgaaaccccgtctccaccagaaaaatatgaaaaccagtcaggtgtggtggcgcgcgcctgcaattgcaggcactcggcaggctgaggcaggagaatcaggcagggaggttgcagtgagcggagatggcagcagtacagtccagctttggctcggcatcagagggagactgtggagaggggagaggggagagggagagggagattgttttctagatttcgtttttggctaggtcgttatttgtgtatagaaatgacatagttttgttttgatattatatcctgcatctttactgaattcagttattatatctgtatttttgatgacatcttttgggttttctacatataggatcatgtcatctgcgaacagataattttacttctctgatttggatatcttttctttccttatccttctcttccttccttcttactttttttttttttttgagacaggctctcactctgttgcccaggctggattgcagcagtgcaatctcagctcactgcaacctctgcctcccgggttcaagtgattctcccacctcagcctcccaaattgctgggattacagatgtgcactactgtgcctggctatttttctgtgtgtgtgtgtgtgtgtgtgtgtgtgtgtgtattttttggtagagacagggtttcaccatgttggacaggctggtctcgaacttctgacctcaagtgatctgcccaccttggcctcccaaagtgctggcattacaggcgtgagctaccatgccaggccttttatttctttttcttgtctaattgctttgatagtacttccagtactattttgtttttgttttttgagacaaggtctcactctgttgcccaggctggagtgcagtggcatggtcatggctcactgcagcctcagcctcccgggttcaggtgtttctcccaccttagcctcccaagtagctgggactacaggcgtgcaccaccacgcccagttaattttttgtattttttttgtagagatggtgtttggccaagttgcccaagctggtctcgaacttgggctcaagtgatccgcttatctcagcctcccaaagtgctgggattacaggtgtgagccaccgcacccagcccttccagtactgttttgaatagaagtggtggttgtgggcatccttgctttgtaccagatcttaatggaaaaggtttcagtttctccccactgatgatgatatttgctgtaagtttttcataaatggcttttgttatgttgaggaactttctttttattttttttcattattttaaaaattttattatttattatttatttatttttttgagatgaagtcttgctctttcactaggctggaatgcagtggcgtgatctcggctcactgcaactctgcctcctgggttcaagcaattctcctgcgtcagcctcctgagtagctgggactacagtcatgcgccaccatggctggctaattttttgtattttggtagagacggggtttcaccatgttggccaggatggtcttgatctcctgacctcatgatctgcccgcctcggcctcccaaagtgctgggattacaggcatgagccactatttagttttttgagacaaggtctcgctttgttgcccaggatggagtgcagtggcatgctcatggctcactgcagcctcaacctcctggggtcatgtgattctcccaccttagcctccctagagtagctgggactacaggtgtgtgccaccaagcctggctaatttgtctatctttggtagagatgtggttttgccatgttgcacaggctggtctcgaactcctcggacttcccaaagtgttgggattacaggcgtgagccaccacacctggccagaactttacttctatacttaaactgttaagggtttttatcaagagatgatgttgggctggacgtgagggtgtgtgcctatagtcccacctacttgggagcatgaggtgggaggatggcttgagcccaggaattcaagtccaacctgggcaacataggagaacctatctctcaaaagaaaaaaaaaatggatgttcaactttgttgaatgttttttctgtgtcaattggtatgatcatgtggtttttgtctttcagtctgtgaatgtgatgtatcacattaattgatttgagcgtgtatatattatacatatatatatatatatatatatatatatatatatatatatatatttttttttttttttttgagacggagtctggcgctgtcacccgggctggagtggaatggtgtgatctcagcacactgcaacctccgcctcccgggttcaagcgattctcctgcctcagccacctgagtatctaggactacaggtgcctggctaatttttgtatttttagtagagtcagggtttcaccatgttggctaggatggtctggaactcctgaccctgtgatctgtccgcctcggcctcccaaagtgctgggattacatgcgtgagccactgtgccggccaatttgcatatattaaaccggctttgcatgccagggataaataccacttgatcccaatgcataatctttttgatgcattgttaatttcaatttgctgatattttatttaggatttttgcatcagtgttcatcagagatattgacctgtaggtttgtttgtttgtttatttatttattttttgtggtttcttggtctggcttaggtatcaaggtgatgctggactcataaaatgtgttaggaaatattccctcctgttgtttttcttggaagagtttaagaagtcttggtaataattctactttgaaaatttggtaaaattcagccgtgaagccatctcttcctgggcttttctttgttgggaggtcagattactttaataacagattgagatatttggaagctgggcctcagttcagaggattagtctgtttttggtttcgactttgttgtaaggtaggcaggttttctttttttttttttgagacagtcttgctatgtcactcaggctggagtgcatgatctcgactcactgcaacttccgcctcatgggctcaagtgattcttgtgcctcagcctctcgaatagctgggattacgagtacacgtcaccacgctcggct

SEQ ID NO: 5 - DNA, 20506 bp, Homo Sapiens
gttctcttagagaaatgtcctgtgggaagggcccgaagcacaggtgacacgcagagcagagagggcccaggaggaaggcaggagatgatggcattgccaaatggtgaagaagatgaggttagatgtgaattgggaaagaatcttcatgtccaggattggttattttgtggactgggttttaaaaaccaaaaacaagttgtgaatgcttgttttcctcaagcagtgctgggcttggccctagtttgaaggtactgacatgtgagggagcactgatggggcagcaatcctctggggtcaaccctggtgcacaccgaattcccttgggctctgcccatggacccaccatgtttttgtgatcagtgggggaaccaaggtagttcaccccaaaggaccacggctctgatcaggactgcactcaaagggcccaaggagcatctcctcgctcagcggctgcacagggggaacagtgcatgcatcaagacattggtcacagaggaggacgctggctttgaacaaaaacataggattggacaatggacaatattccaaacaagacacagatgtgcacagtgttttcaggtaacacaagacattttcatttcctgcttggtgcacagtttacatgaaagctttggtcctgagagtccttttgcagggccatggagacagtcgtggacacacatgatgatggatgagacagagaatgatgagcagaacgtggaggatgtggaggtgctcgggatgagggctgggtctcactctgccctggcctcacactgctgcctcagctcagggtagccctgctgccctcccagaagaggcagacccggctcccatgtggatggagaagggggtgagcctcccatgtggccctccaccatcccatcccacagagagaagccttcactaggctttgcccaggttgactggtcctggcacccccaggcgtccctcttggtggctctccaccctagggctgaccatggggccaggctccctcagcccagtctccccacctgcacagctcagagaatacaaaacccaggagccctgagtcagaggagtggctccgtggaaagacactctaataaggcaagtacaataatggccttagtctaagctgctacgtgtcgccagtgacactgaataatcaaactaaatgaaaaataaatgtcatgtattttgctacataatcaaatggtgaaaatatggcaaagtgtgcaaaacaaagcccttggcaatgcctggggccctgccctggcaggggaggctgtggcaggcccttccctaacactggtttcagagctgggctcctactgtaagggttcctcaggcgtctgaccctctcacatcttgaacctcctgttgacaagaacagagggaaacaccattaaggcaggttccccccacacccagccagctccagaaggacagcggcctgcgcggaggccctggggccaatccctacttccaagttgccaccttggccatgcatctcccttcagaggccctgcgacaacagacgggaggggagtgcgagacgcagccaggctgaagcggagggacccatggatggcagaaagcagaggacagacacgtggcaagcactgggcgtggcagacgcacgaaggcacagagaggcccatcagagtggtcatacgacggggacagggcacactgcttacccggcaccggcgtggggctgaggctcaggatgctgctgccctgcatcctggcctcggctgtcccaagaggcactttcgtggcttccagtaacccttcgccctcggggcctctcagccaggggccatgccaccgtaggtggccccaggtgggactgctggaggtggcacaggggtgggtgcacaggtggccaggacctcccaggaggaacgcatgctggacagagcagtgaccatagcgcacccctcatttggctctgactggtgtgagcacttcctagtttcaacccaccaggaatcccggtcaggctcttcactcttccacggcgaccctgtcttcagcactgggtgtaccacctgctcccaggagcttcacaagccacttgtaaaccacagtgagcccccagggcacatacagtcacatcaagacatcaagacaggacggaccttgcatgcgttctcaaggtgggacccactctcagtccctgcagaccctgctccccaggagtgggatagcaagcagtttgtatcctcaggcagccttagctgggccctctgtccctagggggccaacagcttttcatactgaccaggacagactggccacccctccccaggcacaaagccctgctgcatgtggagtccgaagaatgcaggcgagtatgggggcacaggtttgccctctcggggcgcttttgtcaagagtcccatggactagagtggctactggcttccacgggaaggatggcagccccaggcagcccacccaacagctctgtgccttaagaggtggggagggcagaagactagggcacccctgtacccagggctcaggcctgtgacccccagtgctggcaagaggaacgtgggccaggagagttgtccaggtaaaagagatagcagcgggaaacaaaggtctttggctgaagcatcctaggacacctccccaacgaggagaaggcatggctgtgatcacagggagctcattaaagctcaaggggacaccacgctccgggacagggtgtgtctgacatgcaggggtctttgtgggttttctcctgaattccatgtgctccatcctccaaccactttctctttctgcatttattaaaattatgacccaggatccgggtgcagggtgggcgggtgtttatgtgaggtggagaagggctgagaaattcaacgcatcctttttccgagcactactgaaatggggtccttgctcttccatcctcccggtccagattagagaaacttgccaaaaaatctcacacatacatctacatgggcagggaaggagggtgcaggaaagttcctagagcttaagtggtatttgctttaggcagataaggtatttcccatgaatgaggacagaggcagctgtgccctgcagctggagcacacgccatcacgcaggaggcgggaggggacaggctgggatccccagggattcaggacccttgcaaagttccatagcacatctgtcctccacgtgggggacccgtttaaagactctaaagagaattgcccaaagaggagctccctgagaagtgtttccacatctgctctctgagaatgcagcattccctcgggctcaccccacacagtttgcagaaacccacccgggcttggggataaagccactcccacaacccaggaaggaggggctgaagaagccccttcccaggtggcagagtgctggagggaaaggcaatgggtatttggaaaaagccagggcccattcctaagggtcagtcagttttcacctttcctgagggccacagaggggtggcacacccccttcctggcgaggccacctctgctagcaggttgccctgcacactggccaggtggccacagcctggtctccacaggaatgcagactgcaagtgtgtggagctggtgagctccccagtgagcgcaggccttctaagagaggaagtggagggcgggctggggggctcagcaacctgggcattcctggagctcccaggctattctggacagagtcctgagcacacaggctccgcgtcacagacccccgccccagtctctgcacaactactttcttcataacttagcagaccaacaagggccttaaaaagcacataaatacagaagccggtgtggctggcagggcagcaaagcactgctcccccacggaagtctgagcccctgcccagtctgcatgggggtctgtcctggaggaggatcgagcaaatttacaaagcgccgagagcaagtgaactgtggtccatctcgaggtggcagataactagtttttccttttctgggcagcctttctcttcttctgtcgcttcttttttcctatcttttcttttttccccactttttcttctctgcgcccccttagataaaattagtagaaccattaataatgtggaaataaacaaaagttcgtctcagtctgcataagatttaacactggcccgtgtactggttaaactgtgccttcagtctcaggcctggaggcccctggtcaaagcactgtttatcagtaattcattaaaataaattggacatttccttccattcaaacaaatgttcaatgggctcctagaacacctttgtgaatgggttacagcgactgccaatctgccaacctgaacctgattcccactggggacaaggaatccacatctcagggtacacccagggccaggctggccatcgtggtccttgtcaccccaccctgccctgttctcatgggactttttcttcttctcaatgcagggctgaactcttagctttctctaagaaatgtctgcatttcaaattgaataacgttttggaggctgcaggccccaggttcagactgccattcagaagaggagaaaaaaggcagtggtcccaccttcccctttctagacgcctgtgaacactcctgggaatgaatgcgattgttctggagagcaagggagagagctggttagcagaattttattagagcaactggctcgtgactgtcacattaaaatgattcaagctgaatggtatttaatgatttatggggtgaggccacctgtccctgtgaaagcttcatattaaccatggcctggagtcatgggatttttacatgggaaaatgtaaaaggttgatattactagggttgagtctctggggattacatggggaagttaggagaaccaaggaggaggagggagggaagacgaattagtgagtcaaatattattcttcagaaaaccagcactgctatttcaatcgggttaaaaaaaaaaaaaaaagatccaaaaacttgagctgcagatctaatctgctcgtgagaaaagcccatacactgtcacacatgggctgtgagaaggggtctcagacacctgactgcaggcaggcttaactatataaaccagaaacgtctataagctccatcactaacaactaatgaattttatttcaggtaaataaattcccacatacagtaggacgtttataccatgaaacaattagcattttattgctagtgcatataatgtcacatttgatacaattttagtacaagtgaaaaaatacactgtggctaacattgaaaagctgcaatcacatttatatatcatatatatttctttacaaattgccagtagtttgagataatagagaagtataaactactgacattcatatggctccacttcaaatatatgaattgttcgactataaatatattttgaaatacatttgttttctaaagaaacgtaaaaaaaaatgtgcacaaaaatatatataaaaaaatgccttgcaaaaagttacaaataccaccaggaccttctgtggatcgcatttatgcatggaaatgtcaccttgccaacagttctgattggaacctgaaaccctgctgtggcttcaggagggggtagtggcaagatgatggtttattcactgattttttcgcttctgatttcggaaacctcagagtttgttagtgcctccatggcatacataggcttcagaggcaatcacaaaacccagtcactcaaagcgagctctcagatttaaaattgcatttgattctgtaaagacttgtcttttgcgggtaagcagggggaccattacacatccccaggagagggccagctccattctggaggaggccaaagacggatctcacagagggcccgagctgtggggcaggccctgggaggagagggatgcagggcacgagccccagcaatcaccctcttcccggctggtgcggcgctgatcaggctacagaaatgagaagcagaagcaagattaagcatgctctcggagtcggggagagagtaggaatagctgggagaggggtctctgagcacagtcccagtaatagtggcttctacatggagcccacagagccaatcactgaggttgaaagaggaggtgaaggcagtggcggcgcccagccccagtcggtatctgagtgccacagaggccttcctcttgggaggggcgctgctgcgggagcctcagtgtctgaagaaaggacactttttccagctccctgttaagccaccacctgactgtgcccagactccccaggggagcagaggagatgctccaaacaagccaaattcagatcttgaagtactcgttgatttaaaaaatgagaatgagaatgatgatgattgtgatgatcatgaaggaactaactgcttgaaaatgctgttgataatacaatttctttcttagaaaaaccccagtaataaaagttccaacgtgcacaggtacagggcatggatgaatataagctgcaatatcataccgtatgctataaatgcagggtctaaatgctggcaaacctcaggcccgatcccagatcaatgtgcccaccccacacacacacctggtcctcatggttaaggccccctcccccacgtctttgccctttcatctctcacaaggttttagttttcctcgagtgggtctagcggaaagtcctttttggctgttgtgcttacttgtttaaagctttctccaggtactcctgaatccactttagcttcgggtcaatgcacacttgtctgttgttgttcttcagccgggctctgtgaaaacagaatggcaacagtgtgcggctgcacaggaggaaggcgcggctgcaacgtgtgcatccgctcccccaacacccatctagggccctcgctggcaccccgtgctccacttggtacgctcaggctccagaggtgctcgcggtgtgctggggaaagctcagcgctggcagtgcaggaagttccattgcagagacatggaaatgtgaacagaagtctttccggggcagtgcaggggaattcatgtaagggagcatttgagctgcctttgaaggataagtaggagcttggagagtaaataaacgggaagggaaaatcaggagcaaatacgccaggggggtcatcaaagcatacagaggaaactgaggaaggggacgacaggatgctctaggtacctggggaggggagaatggagagcaacagagcagaggtttatttggatgggtcatcttgatagatatagggccgacttaaggatgggcatgaggaagcctggaggaaggaggcctgccagaagtcaccgcggtctgaccgggagggtgaccagccagggaggggaggggcagtgcaggtggcttaccagaaaatagtttctagaaagattttacaagttcactgaatgtttcttggtctcatttgttttttaaaagttcacactcttaaaagcttccctacatgcaaactcctggggaaggcctgatttcatctctctgaatctcttgccagaaagccctttggtgccaggtaatctcatgcagcccaagtacttaagggtcttgaggacagctaagccccagaacagtggttcaggggcacccagggagtcttcaagcagcctgtccattaggtgaagaggggtgcagagatgggtgtggctcggagcaacccacattggggtccaaatctggggcctattctttgttaatttagtgtctgctcagacctgagaattgtatttggcatcttcaacttcaaggtgcatttccaggccagtaaaccagcatgatcagtgctgtaaagcaggtccaaggtagctaaattgagcatctttaaaatactcttcacaagagataaagtatcatgttgtaggcaaagtacagaaaaaacattcattttctagggccctaaaacatactgtaaataacaaacacattcaaggcagtaaagggttaactcaaaactaaaaacagttttctaaaatcaaaagtaaaaacatttggtgttgggtggaaaagtcttgggaaagttgtagctttggttccaactgctgtctccccaccccatttttagcactagaacttctgagcaatcaaatcctctccaggagactccctgagccctcgcttccccgtgttcagacacaggacctcttgagcatgagagggctttcaagcacatggctttcttcccgcatttctcccggtcttctgtacccagctgagatcttcctgtcttgtggatgtgtgattttggtctttgtttcccaaatgaataaaatcaaatgttagtggctgccatccacaccaaataacaccaaaacctcatatgttgtacttgagaaaatacaggcaagtgagctgaaaatgttgaagtttcacccaatggttaaagaggacttaaactgcatttgggtcttgtgagttaatgtagggcatcagatccccgaaactggcaggccagttatcactgttattagctaagggctggctaatttactaggcttcagccaaaaccttggtgaagcccatagtttctccagcatccagctgtgctgtgctgaagaacacaggtttggaaagaagagagaactactacgagcacagcagggtgcccaggccaagagcggcttttaaaattaatgcctggtggcatactaaaggtcctcatgataagaatagctgccactaattatgccaagttcaaggttggacacttggcttgtcacctctacacctttaataagactcgggttagatgttactatgttcgttagatgcaactatgttcgttagatgatgttcaatttcaagacttacacaatctgaagggcacagtttggagtgttgagaattttgagatgcttgacgttggctctggcaacatggctttcgaagaatcggcatgggcatctgtagctcaggctgacgggcttccctagaagaggtaaggacaacaaggcactttactaccctgccagattttggtaatgtgtgtctgggctgcagcagttggtgcagcgattaaggatcaagagacggcatcactggggtaagttccaggttactggtgtatgttgggaaaggccatctcctcaggcaacacagtgagtgctggctgagctcaggctcagcttctacagggcaaggagcccaacaggcctggggagagccggagcctagatgaggcgggagtttaaattagaagccacctgctcagtgtctcaagataaaggtagtaattatagtagataacggtttcagtccaaggtactgaaatttccagttactctttgtaaaaaaaattcctcaagggacaactgagaaagatctccctactcagggaaaagaaagggggacaagaggctccaggctccctggcctctctcctctggcacaggcctctagccaggaagcacagtagtactcaggaatgctgccctcccccaccccagagacccctcctcacattcacctaaagctctggaaggcacaaaagaatcctggctggcttcctacctgtgagtcccctgagagcaggccaaggacccaccttctgcccagcactttccccaaggcttagagattagtggagctggagttaaatgtggttttcattgcctaggcagggatgctgtagcctcaggaattgtattaagatctttgcaaaatcaccaatttacaaaatgccataattgacactcattagtgtaaattagcaaggggctcctgcagaacccactgctcaccctttaaatataggattgcaagccctggagggctgggatttgtgtgtgctttttgtttttcttttttccttgaagattttatccaagccccacttaataccccaaattatttgaacttgtggatcctttcatcagagattaaatatatgtctaagaatatttggtccagagattttttttcttttttctttttttttaagtttgcctgtttacaaagttctgagagacctctgtggttctgaaattctgcacctttgggaaagaatgctggggaagtaggaggaaatcttgagtaaggggctcattttattttattttttctacagactgcaatcaattgagggatgatgtggactaggaattgcattgtgtattcagccaccaagttgcaggaaaagtggaccacttgtccccccacttccttgtccccaggaccaaatgcaactccctgaaaaccaggaaaaagccaagcatcagggtgctggtgactcatggcactggagagacctaaggcagccttcacagttacacctgatctaactccagaaaggcacctctggggccagcttccagcagctgcactgggaccctgcaggggaagtcagcactgcactgtaaccagatcacctgggaaagccacccccagggccggggcctgcagcctgggtaactgaggagctaaacgctcctgagtgttgtgcctccaggtttccctggatttcttttgggcccttccaagctgaggcagggggtgggttgggggtggagcaggagaataggaggccggtagtgaggcacaagccccctcccggcaacagtgagcttgaagatatgcagccaagggcaagtgctgcagccgcccccgctgggatgggtggggctgtgactctccagcgcccagaggagagaagctcctctggccccccaaccaagcagtggtgatgaggccagaaatcagagcctattcagagctcaacacacaggctctctctcctctccccctccaccccctgggattatccatttccttcaaaagcaattcttgcttctactcccaggacctaaggcccgcctgtcaagcagcgaatttcaacaggtctttttaaagtgacagagcccccaggtgtgcttaccaaaagaacatggtctcgtgtgtacctcatgtgctccttcctccagctttttgtcagtaagactaactttcccaaccgttctggatgtaaatccgtgtaccggcaagagtcctgactggctctgatggtaccccggatttgggaccgggtgagcttggctccaggagttttcagaaagccctccagtctaatgcagagacaggagcccagctggcccctccaagcaggcttgggaagggggcccaccctgagtttaagcccgggaaacccaagggcccagctgcctgacggaagtcagccaatgggggaggggcaggacccctggccaagctctctctgtagtgcagcttgaggactaagtgtggggatagggggcacataggcactgtgaggtgaggggaaaacaaaacaaaacaaaacattctggcgatgtgtgtaaggagcagatctgcctggagcccaggctcctgccctggttacttggctgccaatggggcaactctgagggccatgtcacccttcccaggccaggaggagtctgggatgaaccccacgtctctgtgcttcccccaggtcagttgcacccataactcaaagaccgaggttcctcattccaatcctctctccagccctccggggagggggcagcaccatttcccagagcggcgcactgtgacacctccgcgctcatcccaccaatcagtcaataactgcccaaaccagagaccttacaggaacagaagaatatccagcaataaaaactagaaacatgccccatgacttgcgggggggggggggggtcagtgtgcagacacagcctcagggacttttcatcaacgacgaacattcccaattgccttcagtctgtgtccttaacacttaggcagtccgccacgaccccaggctgcccagcttctccagcccgactcagctgcgctggtcctgctcacaccagcgcacagtccaagccagctaggacgccggggccacgtctgcaccaacccagccaagggctcgaggcgcgctgggcctgcacagcccgcggctgcaagagcactcagagtgtccttcaactctttgcaggaaacttcacagccaaggaagctcagcggcctgagccacagggttttgttttgtgtgttcagaggcaacagtttattttggtttgcatcggtgtcctgtgacagcgcagcgagtttctcttcagcgaaagaaaagaaaaaagccctctcccagtgaaacgggacaccacggttcccagtggcccagggccttggagattgaactttgctgcagctctcattctggggcaaagcgcttggccagctggtgacaaaagagcctgtctgcaggtgtgtttggggagctggggagggggcgtgtgaggctcggagggtccctgggcctctctcaggtgaacccgagaagagacaggaagacagcggctggacgcgcgcccaggtccgcgtcgctgcggaccgcggagctgtgcagaagcgcggcctggcgggtggcacaagcccgacagctgcgccgcgcagcccgcccgcgcctggccaagagccccgcgagggtgtggggagaggatcggcttcgcagggagcggaggctgcgcggctgcatcggacctcacagcctcaagtcgcggcatgaggcgaactttgcaaagcgcgctctcgccatgcaccgcccgacctccagcactgtgcgcagcaggacctcggagcccattcgcctgtggaaaccgagcccgcagcgggaaggcagtgggtggagggtgggcaggcaggggtctggggtccgcggctccccaccctcgcgccttcccgcgccagtcccgaacgctctcttggggcgttcctgcccagttgtcccggctgacctcgctctgcagccagcttgaggtcaggcggtcgctctctgcaggtcacaaaccctcggcgcaaaagtagggctttgaacgcgacaccgcaccagagcgcccagctaagcgagctgcctccacccccactgtgtcgggcggcgcaaactgcgggcgcaggcagaggagccgcggctctgcgccgggcgggagccgaagcccagagcctcgccagggcctccccgccgagcgcacttaccgtcgctgaggcagagcgcggtcagcacgaggaccagcacgaccacgaccttggcgttcatggcgcgggcgggcgggcgggcgggcggacgagcgcgggtcgggggccggacgccgagcgggcaatgcggctgacggagagtgaaagtgcggcggtgggaggcgcgcgccgggcgctttagaggggagagccaggcggggcggggcggggcgcgcggtgaggggcgggcccggagccgagtgctggccgtggccggggtctctgacgcgcgactccctcggcggcaccccccacccatccccttcgcccctcctccgctccctctgtgctcccgaggcgcagtgcgctccggcctttgaccttctcaggctccgctgggccccgcaccgctggcccggtctgcagtgaggtccgcagcctgagcgacgccggctggagggccgcttattgtccctgtgacagggccccactggagagactgaggaccttaggcgtaaagtggggcgcgcgtggaaagctgcgggacggggcctttcgatggcgggaactgaatgagaaccaatgaaaagcaaacaagttagtcccgggcggagggcctgctggcggtggcggcccaaggcagccgagggggtcctgctttctgtgcgtgggggctcaagctcgccacctgcccggcttgcggcgcagccgccggcagagctcgatctgcgggaatgagacccgtctttgcagtcagcgtggctcggactccaagcccacggcgccaccagccgagcctcagtttcctcgcctgtacaaacaaagcagaaggcgccggcggctctcagtaaaagcgaatgtagcctttgtacttccgacctctcaatggtgaaatgagctaatcacaggcccaccccgcggagtgggacgggagattcaatgagacccgccccacgccgcgaaattctctgcatcgtgtctgacaagcagacagtactcaataaatggtagctgtaagtaagtcctttaaacctaagtacttactgccttacccaagaaaagctccgtgcgacccaaagagctgagaactcccccaccccgacctccgactcctaggacagtactactggcgtctgccttctgggtccagaaaactcttcccacggagccgtccctcggcggtgcttagccctccggatacccccgagacatcccagatggccccagtccggtggcgaagggagggtgcaggtcggcacccaggagacgtgggggtgaggagagcgcccctttgggcctcgctttgtgaccgcaggctgccccagccacctctctgtgtccttcccagcacagcgtccagcgaagtggggtcagtcgccgcgtccatccaggggcctgccctggggacacgtccctgtccctggggagtcctggccgtcggggagtgggcggtcagcggctgcattaggcgggagcggtcaacaggaggctgcgagggctccggaactccgctggtgggagtaggtgtcttctgtgcattttttttccaaaaccactttggccgttagatggctgtgggccggcactccatccatccatccatccatccatccacccacccacccacccacccacccaccctgggcactgggcttggagccgggaaccccactgacttggccctgctcttaaagaactgaaggcagtgaggtccagtgaagaaggcagccgtcgggcgtccccaggcctttgctgggctgggccggggagcctggccgctcaccggccgcagcgctggggctccggcgccctctggtggcggcgcctccctccccgctcccagagctctggccagctccattcctgcgcagctgatgaaacccgggagggcgaaggggtccgcgggaaatctacacccgggtggaggggcgccctggagctcggagatccgaccctgcgggagccgcgcgcagcctcgcttgcccttaaatctggccaaagcaaacgccatcgcctctcgcttcttcttcttctttttttctttgccacaaaatcaggtgggcagctggacctaggatctgtcccagaagcctgaaaggcccgcgtgggctgagtcgagggcgaaccagggattcaggcctggccgctgcccctcccgcaggcgccctgaggccccagaacagaagctactgtggcacccatggggccatcccttccgctagtcgttcgttaaatacttactgagcacccactatgtgctagacctgggctacatgtttgaagtagtttagaaaaggcactaaacgtttagaagcacatggcgctaagcataagtaattacgcataaaatacttagaaggccattaaatgctaggggaagatggagcagaggaaagtggggtgggagttaggattttaaatagggtggccaaggatccatattttaggtacaagcctcacaattttacaattggcgattgaaatttaaaaccctggccgggcacggtggctcatgcctgtaatcccagcactttggaaggccgaggcgggcggatcacgaggtcaggagttcgagaccatcctggctaacacggtgaaaccccgtctctactaaaaatacaaaaaaattagccggccgtggtggcgggcgcctgtagtcccagctactcgggaggctgaggcaggaaaatggcgtgaacccgggaggcggagcttgcagtgagccgagatggcgccactgcactccagcctgggtgacaaagcgagactccgtctcaaaaataaataaataaacaaatatgtaaataaataaataaatatgtaaatatgtaaataaaataaaataaaaccctgtacactctgggggcctccgcaccgcctgcacaggcaggcggccatcagaccaggccattttgacatgtctccagctcactcggccacaggggtacctctcaaattcgggtcagcgaagttccccacccctttccctgtgtcctttgcttatgcttatgctcaaaaggctccacctttctttctctgcctggggactcttactccccatagagccccaccttctcctgaagtcttcagactctgtgccgctctaccaggtaatgcagggcacagcggctcctcagggatgccttgttaagcacagttcaaggtgggaggcaggggtctggctgctgagttaaaggcagggcatctcctgagctggcatgtgtgctatggtctctagacccctaggcagcatctgcctacccccctctgcctggcctgggccgttcactcctccagggcccaacggctgggcctgcaagagggttcccagtagggattgaaggtttacactaaatccatgttgtacagtgtgtaattgacaaggtgacttcaggtggtactctgaaatctataaaatatagatttatgtatttatttttttaaagtaataagaaaaaatataactagcacagtaaaggcagatatttcagatattgctcaggttttttttttaatatatggttcaagttttaaaaagtaagtcaattgaagctaacatagcaagtgctagtctaggtggctggagacatagcaaaaattttgacagcaatacaaatagatctgaaatttgaaaaccttttctacatgaagaatattttttgtattacttgacaccctcccaccgcaatccccctcttgaaataagtatttggctccaaagtgctgaaacataaaatcacacaagggaggcacgatgtcttcctcacttgcctgccaggtgaggctggagaacgctggtccaggagcgctcaggtcataggaagactgtggggccctatgggatccctggatacccttggccctgccacccctccaggagtgctcctctcccagctcccgtgcagtcctggagggacccctcccaaccacccacatctgccctcactcctttggcacctggccctggggttcaggagcagatggcctattccaggaaccaggaagcccggtgaggaagacaaatcctcaccgccttgctgatgtcatctgtgcagcaggtacattagctgacatggtggatttggtcagtgtgaaaccacttggcccagagaaggcccttaggaagatactgaacagtggacttacataggactttagtttgccttctttgaatttgtcaatttggtactttcaaagaccgagcttgcagtataagccccactgtctcagctttgaagacatggaacccaagtctccatgggctctgagcccaaggctcagagttgagggcctcggccaacatgacagagccaggcaggagcaagggtacatctctctggggccaacgtctctggatcctggaacatcagccaggtcctgaaagcactcttggggacataagtcactcccatggcagtcatccagggagccttttggaatcccgtacccagggccaggacttggcatttgaccagctggccatgtttttcctgtctagatccccactggcctcaagagccagttgcaaacagccccaggctgccctagagggaaggacccctgggaggcagagctgatccccactggttctgggcacatgtgtgggcaagcaaggcttaccgtcagggtatgtgcacgtctagcaggccaggacttctgtctgagcaggctctgcccaaagacttccttgctggacagtgctgaggcagggggatctgagaatgtaagaataacaaactcagtttctccttactctcacaacacaaaatacttttgtgacttcagatgtgtgtgtgtgtgtgggggggggggcggggattccccacatacaaagccagtagtccttcagctgcagacaccagctggctgtcttctaattcaattcaactctgagatgatctacctggaggtaggctcaggccccacatgttgaggccccagtcccacaaggctgcccctacttcagataccagttgcaagccctgggttgttttcccagtgcttctgaccaaatgaccataaattagggtttctatgaccccatccttgggtttcattaatttgctaccacagctcatggaactcagggaagcacttatgtttactggtttattaaaaagggtattatgggctgggcgtggtggctcacggctgtaatcccagcactttgggaggctgatgtgggtggatcacctgaggtcaggagttcaagaccagcctggccaacatggtgaaaccccatctctactaaatatacaaaaatcaactgggcttggtggcgggcacctgtaatcctagctacttgggaggctgaggcaggagaatctcttgaacccgggaggcggaggttgcagtgagccaagatcacaccactgcacttcagtctaggtgacaagagcaaaactctgtctcaaaaaaaaaaaaaaaaggatattatgaaggctacaggggaagagatgcatagggcgaggtatgggggaaggggacatgaagcctccatgccctctccaggcaccatcctccaggaacctccactgtcgtgaagccctctgaaccctgctttgttgtgtttgtatagaagctcattacataggcatgattgattacattactggtcattggtaacttagccttcagccctgtttccttcctcagaggctgatggggtggggctataagttcccgccttctaatcctgcttggtctttctgatgactagcctccatcctgaagctacccaagggttgccagccatcagtcaagtaaaccaaagattttaggagctgcatgccaggaagctgggacaaagaccaaatatatatttcacaatagcacagttggtatttcctgggacattccccgggactgtcggactaccagggctcatagggcaaatcagacccaaggccccaggggttcagatctgtgctcccagtccccacaccagttcccaggaaccaagtagtgaacccttcctgtgctcagtcaccacagtcaggcctggattccttctgcctccctttcctagccccacccctctctcctattccccttgcctctgggcagactggactcagcagctggggatccactgaaggttctcatactggagtatacatcagttcctacctatcagaaaccccagagtgtgcacactgagagtgtgaacagcattgacactggagtcaccctgtgctgcgtgccttctgtcacctttctccttgcatctagctgatgaggtgggttcaatggcaaggccattccctgaaataagggacagagatcacaaaactattatttgtcagggatggagtttaaatccactctgaagtagggctgttcctggtgaaggagaaagagctggtttgccacataaaacacagcatgcccagttatgtttgaatttcacaaaaaagcaagggattttgtgtatttgttttttgtttgtttgtttctttttgtttttaagtatcagtgtgtcccaaacattgcatggggcatggggcatacttattaaaaagaattatcagtgtttgtttgaaattcaggtttaacggagcatcctgtattttcatttgcagagtctatgcttgtcacattgccacagccccccgccttgtggtcttctgcctgaaccttcagaacatgtggttgaggttgggaagggaagttatggagtcacttttttttttcattgagaggatttcttgagttttattaacacagagatgctagaaagtggtgcatgaaagcaatataggaatgatcttttcttgttcttctttctgggttgagcagtgtaacacagcacctgccccaaccctacccttccagaaatagtcctggccatgcctgaagcaagggtaggcaggtctcttatccccaatatcaccagccctgctcttcctctggtcccggcagatgtgtatgatgcccagctactgacactctttccatctatttcaggtgggtgagctgtgggtggagaaggaggggagaaatatctcagggaagagggccacgtgagcaatatcctgggctggtgggattctgcaggagaggaaagagctcaagagctgctgtgggttgtaaaggaggagctgggtctgctgcctgcacagatggtcccttccaattagaaaagccaggattccagctccactggccctccttgtttggaagaggagtttttacttctttctccaccctacatccctgtggcggggtgtctgtagtcttactgcatggatgatctgaactgggctgtacacagaggctactgagagaggctttcaaggctgagtgcaaatgcgggcttcaccagcagcctggcctaggggatgtaagtgggagatggactcaggtggggatacctctgaggtatccatccattcatctactcacctacccatatattaatccattcatctattcacccactgaaacacccagtcatccatccatacgtccatccaacacatgtacccatccgtccatccattcatccattcatccacccacctacccatacattaatccattcatcattcacccaccgaaacac

SEQ ID NO: 6 - DNA, 30068 bp, Homo Sapiens
ccgaatagaatgggcctgtgaggctggaaggaggtattttccttggtctaagaaccatttgccttgtgtgggaagagattgatgggtggaagtttcagtgggggagtaggtgggagtgactgatgagaaggagaaaaactggctgtgggggacagaaattggcatgctagctgcttgtctagctaccttatcagcataagcatagatgtgagagacagaagttggaaagctagctgcttgtctagccaccttgtcagcataggcattgtctagagcaatgggatctgatgacttttgatggcctttgcagtgaatgactccagcttcctttgggagtaaagcggccttgagcagagtttttattaaggaggcattaaagatggaggacccttgtgtagtgaggaaacctctttcagcccatatgaccgcatggtggggcagaatatgaaaggcatatttagagtcagtataaatattgatgcatagtccttttgcatcagtgagggcttgagttaaggcaactaattcggcttgctgagaggtagtggagggggcagagcggtagcctcaatgatagatgtggaagatactatagcatagcctgcctttgctggtgagtggcgattaggcctggtggaactgccatcaataaactaaatgtgattagggtgaggaataggaaagaaggaaatgtggggaaatggggtgaatgtcaggtggatcagagagatacagtcatgggggtcaggtgtggtatccggaataatgtgggaggccggattgaagtatgggccagtaacaatggtgattgtgggagactcaacaaagagtgagtgtagctgaaggagccgggaagcagaaagtatatgcgtcaggtgtgaggaagaaaatagatttttggaagttatgagaactgtagagagtgagttgagcatagtttgtgattttgagggcctctaaaactattaaagcagcggcagccgctgctcacagacatgagggctaggctaaaacagtaaggtcaagttgttcggacagaaaggctacagggtgcggtcctggctcttgtgtaagagttccgaccacgctaaccatgcctaggaaggaaaggagttgttgttttgtagaaggtgctggggcttgagagatcagtcagacacgatcggcatggagagcacgtgtgtttttatgagaattatgccgagataggtaacagaggaggaagaaatttgggcttgactgaagtaatgggggctgtctgtgaagctttgcggcagtacagcccaggtaatttgctgagcttgatcggtgtcagggtcagtccaagtgaaagcgaagagaggctgggatgaagggtgcaaaggaatagtaaagaaagcacgtttgagatccagaacagaataatgggttgtagaggcaggtattgaggataggagagtatatgggtttggcactacggggtggataggcaaaacaatttggttgataaggcgcagatcctgaactaatgtgtaagccttgtctggttttaggacaggtaaaatgggagaattgtaaggggagtttataggctttaaaaggccatgctgtagcaggctttaatccttttaaagcgtgctgcggaatgggatattggcgttgagtggggtaagggtgattaggttttaatgagatggtaaggggtgcatgatcggtcaccaaggagggagtagaggtatcctatacttgtgggttaaggtggggggatgcaagaggaggaagcaaaggaggctttggattgggaagaatggcagcaatgagatatagctgtagtccaggaacagtcagggaagcagataatttagttaaagtgtctcagcctaataagggaactgggcaggtggggataactgaaaaggagtgcttgaaagagtattgtctaagttggcaccagagttggggagttttaagaggtttagaagcctagctgtcaatacctacaacagttatggaggcaagggaaacaggcccttgaaaagaaggtaatgtggagtgggtagcctccatattgattaagaaggggacgggcttaccttccactgtgagagttacctagactgtgatggtcctgtaggcttctgaggcgatcgggatcgggcagtgtcagtcttcagctgctaagccgagaagatctgggaaggagtcagagagccttgggccagagttctagctgctctgggagtggctgccaggtgagttgaacagtccgattttcagtggggtcccgcacagatgggatgcggcttaggaggaatcccaggctgtggacattccttggcccagtggccagatttccagtacttgtagcaagctcctgggggaagaggttctggaggaacccctggcagctgcggttcaggcgtttggagttctcgtgtgctggagatgtggctggggtttgtctcatctggatactggagtggaggcaaggaattgcaactcagaaatatgttgctatttggctgcctctactctattactgtacaccttgaaggcgaggttaattaagtcttgttgtggggtttgagggacagaatttaatttttggagctttatttaatgttgggagcagatttggtaataaaatgtatattgagaataagacggccttttgacttagggtctagggctgtaaagcgtctcagggttgctgccaaatgagccatgaactgggctgtgtttttaaatttgatgaaaaagagcctaaacactatctgatttgggagaggtcagataaagaaaaaggagcattaaccttgactatgcctttagcttcagccacctttttaagaggaaattgctgggcagttgggggagggctagtcatggaatggaactgtaagctggaccgggtgtgaggaggggaggtgataaaaggattatagggtggaggagcggaggctgaggaagaattgggacccagctcggcctggcgaggaggggagatgtcagatgggtctgtagaaaaggaagattagaaagactcagcgatgcttggggttgggactgacgggacaggcgggagggaaagaaggaagatttgggacgagttgcactgggcatagagactagggagggaccgatgtgtaaaagaatgcctggatgtcaggcacctcagaccatttgcccattttacaacaagaattatttagatcttgtaggatggaaaaattgaaagtgccgttttctggctatttggaaccactgtcaagtttgtattggggtcaagcagcattgcagaagaaaataaggcatttaggttttaggtcaggtgtgagttgaagaggttttaggtttttaagaacacaggctaagggagaagaaggaggaatggagggtggaaggttgcccatactgaaggaggcaagcacagagaaaagagagagtagagacatggagggaaggggttcaggggttcttaccttccagaaaagcgggaaaggggtcagggcacagaagtaagggattggggtgcagagacaagaggtcggggtgtggaaataagggatcggggtgcagagataagacgtcagggcacagaaataagggatcgggggattcttgccccctagaaaagcggtacttgccactaagggtgaaggagaaggggttggggggttcttgcccccccagaaaagcagagaaggggtagagacacagagaaggagttgggggttcttgcccccccagaaaagcagtacttgccactaagggtgaaggaccaaggcaggcatccccatgtggtcagacacctctgaaacgtgggtgaataatcagagaggtgtccctgcgtgattaaacaccaagggaaggctgccttcccgagtccatgaccggcgctggagttttgggtccacgaataaagcgcgtctcctgtctctaccagaaaaggaaaggaactgaaattaagagaagggagagattgaagagtggaaaggagaaagtggttgagggatagtgagagaggttggagaagagagtaaaaagaggctgcttactggatttaaaattggtgagatgttccttgggctggttggtctgaggacgagaggtcgtaggtggatctttctcatggagcaaagagcaggaggacaggggattgatctcctaaggaagatcccctgattcgagttatggcaccaaatttcactcacgtccgtgtgaagagaccaccaaacaggatttgtgtgagcaacaaggctgtttatttcacctgggtgcaggcgggctgagtccagaaagagagtcagcaaagggagataggagtgcggccgttttataggatttgggtaggtaaaggaaaattacagtcaaaagggggttgttctctggcgggcaggagtggggttcacaaggtgctcagtaggggagcttttgagccgggatgagccaggagaaggaatttcataagataatgtcatcacttaaggcaagaacaggccattttcatttctttcgtggtggaatgtcatcagttaaggcaggaaccggccatctggatgtgtacatacaggccacagggggatatgatggcttagcttgggctcagaggcctgacagtctggatcacctgacctggtgatccgcacacctcggcctcccaaagtgctgggattacaggcatgacccactgcacctggccttagaaaacttcttaaatattaaaatgtatgttatgtgtattttgccacaatttttgaaaagtaccttctggtgtttagagacagaagatgagtggttgcctagggccgggagagtgaggggatcgtggtgatgggcagctggtcggcatggggttctgaagggcagtgatgacaacattctaaaattagactgtgttgacggttgcaccaactccgtgaataccacaaaatttaaaccattgaattatgcacttttaatgggtaattgtatggcatgtaaattatatctcaataaagttatatttttaaataccaaaaaaaggccgggtgcggtggctcacgcctgtaatcccagcactttgggaggccgagaagggcggatcacgaggtcaggagatggagaccatcctggctaacatggtgaaaccccatctctactttgaaaaaaaaaaaaaaaaaaaaaagattacccggacgtggtggtgggcacctgtagtcctagctactcaggaggctgaggcaggagaatggcataaactcgggaggcagagcttgcagtgagtcgagattgcgccactcaggaggctgaggcaagagaatggcataaaccccggaggcagagcttgcagcgagccgagattgcgccactgcactccagcatgggtgacagagcaagagtccatctcaaaaaaaaaaaaaaaaagattagtaatatcctctgtgtcacttaccacttaagtgattgaatcacgacttgaaattcatcatctcaaacatggcttagagtctgtagaggggggacagtcccaggaatgctggtgtgggcttaaggctgaattaaatagatccagatggctcacacctgtaatcccaataccttgggaggccgaggcaggtgggaggctgaggcaggcggatcactggagctcctggagcgaagaaaggatgctagtggaaaaactggtgaaatcagaataaagtctatagttttattttttaaaggaggctgggcgtggtggctcatgcctctaatcccagcactttgggaggctgaggcaggtggatcagttgagttcaggagttcgaaaccagcctggccaacttgacgaaaccccatctctactagaaatacaaaaattagctgggcgtggttgtgggtgcctctaatcccagctactcaggaagctgaggcaggagaattgcttgaacccaggaggcggaggttgcagtgagctgagatcacaccattgcactccagcctgggctacagagcaagattccatctccaaataagagagacatgacaattaaataaattgtgtaatcttggattaaatcctaaaccaaatatatgtcactggtaaaacaagtggtgaaatttgaataaagtggatagatcagacaatagtgtcatatcagtgctatttcttgaccttgaacattaataacagaatgtccttggttttgggaaatataacctgaagtgattagaggtttagggcatcatatgcaaattagacacactttcttcggggagagagggagagggagagaggctgaatgatgaagcaaatgtggtaaaatgctaactttggggaaatctggatgaagaaattacagattttttttttttttatagacagggtaacactctgtcacccaggctagagtgcagtggcacgatcatggctcactgcagcttctacctccctgggctcagatgaccctctcacctcagcctcccaagtagctgggactataggcgcacagcaccacacctggctaatttttgcatttttttttcccccaggctcgtctcaagcaatccacccacctcggcctcccaaagtgctgggattacaggtgtgagccactgcacctggccagaaattctttaaactatttttgcaagtctggaattatgtcaaaattaaaagctcaaaataataaaagacaatattcttatatttctttggtgaaggtaactatgttatggctgagagggtggctgaggtctgaggatccagcctacataagtctcctccatagagggcatccaagcgctccgtagggggaaggataaagaaaacacccagagttatgacagctgtgtaaggggaaacgccagcaccgagtactgaatcttcagtaaataagaaggaggcgggctgggtgtggtggctcacgcctgtaatcccagcactttgggaggctaaagtgggctgatcacttgaggtcaagagttcgagactagcctggccaacatggggaaaccctgtctctactaaaaatacaaaaattagtcgagtgtggtggcacacgcctgtaatcccagctacttgggaggctagaacaggagaattgcttgaacccaggaggtgaaggttgcagtgagctgagattgcaccactgcaccccagcttgagggacagagtgagattccgtcttaaagagaaaaaaaaaagaattagcacatttgtttgcctcaagaagatacaactagtcttgtacagtagtcacatgtatccaccaggatatattccaaggccccagtggatgctgaaaactacatagtaccttacatgtatatatatatgtatatacatatatacacatatacgtatatgtatacatacatgtatatatgcatgtatgtatatacatatatgcatatatacatacatgtatatatacatgtatgtatatacatatatgtatatgtatgtatacacgcatacatgtatgtatacacgcatatatgtatgtatatacatatatgtatgtatacacgcatacatgtatgtatatacatatatgtatgtatacacgcatacatgtgtgtatacatatatatgcatgtatgcatgtgtgtatatatacatatatgtgtatatatacgcatatacatgtatgtgtatatatgcatgtgtatatatacatgtacggtactatgcagtatatatacacatatatgtatatatgtatacatatatgtataaatgtatatatgtgtatatatataaaaggtatatatgtatatatgtgtgtatatataaaatgcatgaatttcttttttcttactgtagatcttaacaacttctgcatagaatttttttttattaagtggagagttagttacttacttaaaagaaatgtttcttggctgggtgtggtggctcacacctgtaatcccagcactttgagaggccgaggcaggaagattcacttgaggtgaggagttggagaccatcctggccaacgtggtaaaaaccggtctctactaaaagtacaaaaatgagctgggcgtggtgttgggtgtctgtagtcccagctactcaggtggctgaggcaggagaattgcttgaacccacaaggcagaggttgcagtgagctgagatcacaccactgcaccacagcctgggcaacagagcaagactctgtctcaaaaaaaaaaaaaaaagaaagaaaaagaaaaagaaaagaaatgtttcttttcttattaagttctttaaatgaaaagcttttcttttcacttttattttattgaaacattataacactatctttgaagaagttagtgttatcattccattctgatgaaaccaattaacttatccaagcatatgtatactgtacacagagaagccaacgtcaaaacccctatttttatctttttagattcagcagatacatgtgcaggttttttatgagtatattgcatgatgctgaggcttgcattaatgatctagtcaccaaataggtagattttcaagccttgctcccctccttacccaatgtttagcgctctcacttataagtgagaacatgtggtatttggttttcttttcttttttttttttttttttgagatggagtttcactcttgttgcccaggctggagtacaatggcaccatctcggctcactgcaaccttcaccttccaggttcaagcaattctcctgcctcagcctcccgagtagttgggactacaggcatgtgccaccacacccggctaattttgaatttttagtagagacagggtttctgcatgttggtcaggctggtctcgaactcccgacctaaggtgatccacctgcctcagcctcccaaagtgctgggatgacaggcgtgagccaccgtgtctggccagtatttggttttctgtttctgtgttaactcgcttaggataatggcctctagctgcatccatgttgctgcaaaggacataatcttgtgatttttcaaggctgtatagcgttctgtggtgtatacatatcacattgtctttatccagtccacctctgatgggacctgggtggattccatgtcttcactattgtgaatcctgctgcaatgaacatacaagtgcatgtgtctttttggtagaatgatttattttcctttggctatatacccagcgatgggattgctgggctgaatggtaactctgtttgtagttctctgaaatatctccaaaccaaactgctttccacagtggctgaactaatttacacccaccaacagtgtataagtgtcccctttgctccacaatctcaccagcatctgttaatttctggcttttcagtaatggccattctgactggtgtgagatggtattgttgagggataatttaggaatcagagagaccgaggggttgaggaggatttattattattattattatttaggtgcaccggccccagtcagattaacatccaaaaagactgaggctcgaacagagagtccggttaccttttaagcattttgtggggttgggggagatctgtgcagggggaagcatattacagaagcaagaaacaaaggcagttattcaattgagacatgcatcacattattccttacttttcaagaaaaatatgttttacgacttgaggttatcctgtctagtgatcttgcagccgcacggcaagagaaacagggtcttcacaatgcctgggaaagggagagataaggctcactagccacagacagaaaaacaggcagttcatgtttaaaggactccacctctttctcttcctcggggggaactgggttttcttaaatacaactgagtttttgtttacacattctgtaatttcttttaattcctgttccagtatctcactgtgaaactccctatgtttttatacgattctcagggggtttcctctgggcatgattgggcacaacttcccacagtcagctctgggtacgacctccacattgcagaattgagaagttgacccagaaatgcattttgggctgagcagacaattgtcagagttgctggctagaccacagatgtgtcagagggaccacggcctttctgtaagctcatggtcagaggcggaggggagttgtgaacgttctgatgaaagcagtcaacgtgaaagcgctctggtgatgggcgctggtgctcacccaccacttcctgtgtatctatctccctggcccgcccggctcagtccccactgctcagcactaggccggcagaatctgagcgatgtcttccacactccctgccctgctctgcgtcggtgagttctggcgtggaaggggaatgggatcacggtgtgcctgggaggcaacaggtctcattactcccgtcttccagggctgtgtctgagtcagaggatcagcgcccagcagcgtgagtccttccttcaaagcccagggtcactcttccgggttcaggccaagctccttccacccaagcacggctggggagaggggacagggtgctggcttcccaggagagcttggggccagcagctgggtggagcctaaggttggggggagggggctccgctggaactccagcctctgattcccttccagagactctcccaaaaccgttcatctgggccgagccccatttcatggttccaaaggaaaagcaagtgaccatctgttgccagggaaattatggggctgttgaataccagctgcactttgaaggaagcctttttgccgtggacagaccaaaaccccctgagcggattaacaaagtcaaattctacatcccggacatgaactcccgcatggcagggcaatacagctgcatctatcgggttggggagctctggtcagagcccagcaacttgctggatctggtggtaacaggtaactgtccggttctctaactggagagtgatctcagtctgcatccgggatgcagcatcatctatgaactcttccaagccccactcagacactgcttgtctcggtaggaggctggaaggaggggtgatccccatcacaatccttgcctacaaggggttgtctgcagaccgtgtctctacgtcctaggagcagatgtgtcctcagtcagtttctccatgacacagattctgagatagatatttgtatgcaggggtatgactgaggaatgtcctcaaaaacaatgcctgtgggctaggcgcagtggcttacactttgcttccctcacccatcacaggtggtgggttttttttttttttatctgttttgagacggagtttcgctcttgtcacccaggctggagtgcagtggtgcaatctccagtcactgcaacctccacctcctgggttcaagtgattctccagcctcagcttcccaagtagctgggatcacaggcacccaccactacgccacattttgtatttttagtagagatggggtttcaccatgttggccagggtggtgtcgaactcctgacctcagatgatccgcccgcctcaccctcccaaagtgctgggattacaggtgtgagccatcacacccagccaggtggtggttttctaaaaaaaaaaaaaaaaattagctttttttttttttaacaatatggttgtttattattattatcaagtattatacatagttacatatacatacataattgtatgtgctatacaattaggtttgtttataccagcaacaccaaaaacacatgagcaatactttgtgctaggaaggctatgatgtcatcaggcaataggaatttttcagtttcattataatcttatgggaccaccatcatatatgtggtacattgttggccaaaatgtcattatgcagctcacaacagtatttcatgtccattcaaatatcttcttttgtgaaatgtctatttaaatcttttgcctatttttaaattgggttgcttatattttgattgattaggaaaagttatttctatattctgtgtcatatacttgtgttgaaatatatatattttttgtctgtgccttttcatttgctcagggtctttggaccttgtttggaggttctggcaggggaacacagctactcatttattcttttttttttaatttttttagtatttattgatcattcttgggtgtttctcggagagggggatttggcagggtcataggacaatagtggagagaaggtcagcagataaacatgtgaacaaaggtctctggctttcctaggcagaggtccctgcggccttccgcagtgtttgtgtccctgggtacttgagattagggagtggtgatgactcttaaggagcatgctgccttcaagcatctgtttaacaaagcacatcttgcaccgcccttaatccatttaaccctgagtggacatagcacatgtttcagagagcacggggttgggggtaaggtcatagattaacagcatcccaaggcagaagaatttgtcttagtacagaacaaaatggagtctcctatgtctacttctttctacacagacacagtaacaatctgatctctctttcttttccccacatttcccctttttctattcgacaaaaccgccatcgtcatcatggcccattctcaatgagctgttgggtacacctcccagacggggtggcggccgggcagaggggctcctcacttcccagacggggcggccgggcagaggcgcccccccacctcccagacggggcagtggccgggcgggggctgccccccaacctcccggacggggcggctggccggggctttttttttttttttttgagacagtctcgctgcagtgcagtggtacaatctcagctcactgcaacctctgcctcagcctcaattctcctgcctcagcctcccaagtagttgagattacaggcatgtgccaccacacccggctaatttttgcatttttagtagagacggggtttcaccatgttgaccaggctggtctcaaactcctgacccaggaggtcgagtcttcagtaagcaaagatagtgccacggcgctccagcctgggaaacagagcaagaccctgtatcatttttaaaaatggttttagacggtaaatcttctattgtgtgtatttgaccaaaataataattaaaaaaaaaaaaaaagctggctgccaggcatggtggcaggcccctgtagtcccagctacttgggagggtgaggcaggagaaacgcttgaacccgggaggcagaggttgcagtgagccaagatcgtgtcactgcactccagcctgggcgacagagagagactccatctctaaagaaagaaaaaaaaaaatagctggctgctcatcactgagtttctggtgtggtggccccaccttctctcatagaaatgtatgacacacccaccctctcggttcatcctggacccgaagtgatctcgggagagaaggtgaccttctactgccgtctagacactgcaacaagcatgttcttactgctcaaggagggaagatccagccacgtacagcgcggatacgggaaggtccaggcggagttccccctgggccctgtgaccacagcccaccgagggacataccgatgttttggctcctataacaaccatgcctggtctttccccagtgagccagtgaagctcctggtcacaggtgaggaaatgctcaattccccacacccttcgccgccatgtcctacctggagccctgagggatccccagagagtgatggggagggtgtccaagggacgtccacttcctgggtgcctggttggtcatgtgaggaagaacaccagaagcaggaaggaggagggagcagagaaaggaatggtaaggcgggtggatcacaaggtcaggagttcgagaccagcctggccaagacggtgaaaccccgtctctactaaaaatacagaaattagccagacgcagtggcggacacctgtagtcccagctactcaggaggctgaggcaggagaatcgcttgaacccgggaggcgggggttgtagtgaaccgagatcataccaccgcactgcaacctgggcgacagagcaagactccatctcaaaaaaaaaaaaaaaaaaaaaaagaatggcaagaccggaggaaaccaaaaacccttacttttttttctttatctccttttccaggcgacattgagaacaccagccttgcacctgaagaccccacctttcctggtgagtaactggtccttctaagctcagacgagcgatcagagcctcccagtgacactaaaaacgtggcattcattcaaaatattcatcgaggccaggcgtggtggctcacgcctgtaatcccagcactttgggaggccgagatggtgcatcatttgaggtcaggagtttgagaccagcctggccaacatggcgaaaccctgtctctactaaaaatacaaaacttaggctgggcatcatggctcacacctgtaatcccaacacttcgggaggccaaggtggttggatcacaaggtcaggaattcgagaccagcctgaccaacatggtgaaaccccatctctactaaaaatacaaaaattagccgggcctggtggtgctcgcctgtaatcccagctactcaggaggctgaggcaggagaattgttgaacctgggatgcagaggttgcagtgagctgagatcgcgccactgcattccactccactgcacgacacagcgagactccatctcacagaaaaacaaaaacaaaactattatatatatatattcatcaagtgcatagtatacacagtgaactacactgtaacagtcagccaggcagatatcttgactctgcagcacttagattctagcaggaggagacacaccatcggtcaacgtcaggatagcacacaggagggaatgatgctatggaaggaaaagacaaagtagaacagacttacagtgattgaaatggcagctagcaatattaaataggtttgtccagatggacctcacagagaaagaaggcatctgagcaaatgcgttcagacttgagttaatcatgtggctgtcaggagaaaggaggctctggagagaatgaaatggcatctgcctgtgccctggggcaggaagataactggggtaatacaataataactatgaggccaggagggttgaaaatgatgtttggaagatgacggtgggatgggcctggggcgcacggctaggattacaggagtgaggcccggcgcggtggctcacgcctgtaatcccagcactttgggaaaccgaggcaggtgggtcatgaggtcaggagatcaagaccatcctggctaacacggtgaaaccctgtctctactaaaaaaaaatacaaaaattatccgggcgtggtggcgggcgcctgtagtcccagctacacaagaggctgaggcaggagaatggcgtgaacccgggagacggagcttgcagtgagctgagatcgcgccactgcactccagcctgagcgacagagtgagactccgtctcaaaaaaaaaaaaaaagaaaaagaaaaagaaaaaaaaatagtgagactttgaatttcactatgtgtgtatgtgtgaggagaaagaggtaatgatgacttaatgaggaaaatgaggcttaaatagaagacgggctgggccgggtggctcccgcatgtaatcccagcactttggaaggcaggggcggctggatcacttgaggtcaggagttcaagaccagcctggccaacacagtgaaaccccatctctactaaaaatacaaacatgagttgggtgtggtggcgcacgccagtaattacagctactcggggctgaagcaagaggattgcttgaactcgggaggcggaggttgcagtgagctgagatcacaccactgtactccagcctcagaggcctgtcatcccagccctttgggaggccgaagcaggcaggtcatctgaggttgggagttcaagaccagcctggccaacatggcaaaaccccgtttctactaaaaatatgaaaaaaattacctgggtatgtggtgtgtgcctgtagtcccagctactccagaggctggaacacagtgagactctatctcaaaaaaaaaaaaaatagaagacatgactggtgcaaagacacatgctcacaagtgctagaatggaattcctcgtcaggttcgtccatctgtggacccttccactttacctgctggatgaagctcctgggacccgcagggtgaggtgggaccttgtaaagctgcagaacgtcatggggtagacccaagggaaggagtgctggggtggaggaggtcaaaaccatcctcttttcttcacttcccttatcatcagcagacacttggggcacctaccttttaaccacagagacgggactccagaaaggtaagtagacagctggggccataggctctgaaggaaggggctgggcatagagtagacctaggaagggaatctaaatgggaacaagagggtgtccttggccaggcgcagtagctcacacctgtaatctcagccctttgggaggccgaggcgggcagatcatctgaggtcgggagttcaagaccagtctggccaacatggcgaaatcccatctctactaaaaatacaaaaaaattagccaggcgtggtggcgtgtgcctgtagtcccagctacttgggaggctgagacaggagaatagcttgaacccaggaagtggaggttgcagtgagccgagatcgtgccattgcactccagcctgggcgacaagactgaggctctgtctcaaaaaaaaaaaaaaaaaaaaaaaaaaaaaaaaaaaaaaagagggtgtccttacatccctgtcagcgatcaccctgttctcctgcctacagaccatgccctctgggatcacactgcccagaatctccttcggatgggcctggcctttctagtcctggtggctctagtgtggttcctggttgaagactggctcagcaggaagaggactagagagcgagccagcagagcttccacttgggaaggcaggagaaggctgaacacacagactctttgaagaatgaccatgagacacagtggccatgggtggatctgaaagctggtgttgagcctgggcggcgtgagctctgtgttggacccacggaggagggagtcactgcagggaaagagggacactggcattccatttgtcagagcatcccggacgatgcagagggtgggagaactacatgctaaatttctttttttttttttttgagacagagttttctcttgttgcccaggctggagtgcaatggcgcgatcttggctcactgcaacctctagctctccatccctcgggttcaagtgattctcctgcctcagcctcctgagtagctgggattacaggcatgtgccaccaccccagctaattttgtatttttagtggagacggggtttctccctgttggctggtctcgaactcctgacctcaagtgatctccccgccttggcctcccaaagggctgggattacaggcataagccgctgcgcccagccactgaatttcttctgtagacaaatcctatggtctcttctaggctctaactatttttgtaccacttactgcaaaccatacttttaaccactctggtcttttctgaaaagatctctccttctttaacaggatggccatggaaatatttttttcctactttggtctttttttctttcctttctctgcaggaagccattcaaaatagttaataaccaatatagaataggtctgtatcaaatggttcaggaggcattgtggcaacaaccagttgtagagaagcagctttataagtgaatcctgccaggcacggtggctcacacctgtaatcccaacactttgggaggctgaggcgggcagatcacctgaggtcaggagttcgagaccagcctggccaacatgatgaaaccccatctctactaaaaatacaaaaactcggccaggcacggtggctcatgcctgtaatcccagcactttgggaggccaaggtgggaggatcacctgaggtcaggagttcgagagcagcctggccaacatggtgaaaccacatctctactaaaaatataaaaattagccaggtatggtggcgtgtgcttgtaatcccagctactcaggaggctgaggcaggagaatagcttgaacccgggaggcggaggctgcagggagccaagatcgcaccactgcactccagcctacgtgacagagcaagattctgtctcaaaaaaaaaaagaaaaaaaaaaaataagtgactcctggctgcatcccaaccataccccaattccttctaaccacagaattattccatcttctcttccttttttttttttttctttttttttgtttgttttgttgggacagaatttcactttttttttttttaatgtaagttttagggtacatgtgcacaacgtgcaggttagttacatatgtatacatgtgccatgttggtgtgctgcacccactaactcgtcatttaacattaggtatatctcctaatgctatcccttcccccgagtttcacttttgtcacccaggctggaatgcagtggtgcaatcttggctcactgccacctccacctccagggttcaaatgattctcctgcctcagcctcctgaatagctgggattataggcatgcaccaccacgcccggctaatttttgtatttttagtagaaatggggtttcacaatgttggccagactggtcttgaactcctgacctcaggtgatccaccagcctcggcctcccaaagtgctggaattacaggtgtgagtcaccgtacccggccaccatctttgcttctttatccacaccttgccttgttcttcagggctctgcagagatatcatttcctccaagagtttccacaactccgacttcacaaagatagcacttttttttttttttttgagacagtctcactctgtagcccaagctggcgtgcagtggcacaatctcagctcactgcaaccttcgcctctggggctcaagcgattctccttcctcagcctcccaagtagctgggactagaggcgcgcgccaccacacccggttaattttttttgcatctttagtagaggtagggtttcatcatgttgccctgggtggtctcaaactcctgagttcaggtgatccccccgccttggcctctcaaagtgctaggattacaggcgtgagccactgcgcccagccaagacaacactttcctcatcccaaagcacctgttaattccctgtaacagcacttgaaccctgattcggcatgcatgtccattttcctgcctctaccgtgaactcgtgtgaattgatctatgtcagatttagtggctgcattcacagctcccgcaactataacggggttctcgggaaatatatatcaaatgagtgaatgtatatacggggctgtggcacagcctgcaacttgagacttctcactaggggtcttgaaatgctgtctggacaccaccatcgctttcctccctgagaacttctacttatcaacccatttatatactcatcgcatgggtcctcacgccctcccattattctggtgcctcatgccggtcaaatttattctctaaatctgatttttccattaaatagcagcctggccaacacggtaaaaccccatctctactaaaaaatacaaaatattagccaggcgcagtggcttgcacccgtaatctcagctactcgggaggctgaggcagcagaatcacttgaacccgggaggcagaggttgtggtaagccgagattgcaccactgcactccagcctggtaacagagcgagactccctctcaaaataaataaactgctgactcgcgtattttttctttaccccaactcattccttacatgtaggcacctgtaatcctagctactcagaaggctgaggcaggagaatcgcttgaacctgggaggcggaggttgcggtgagccaaaatcgtgccactgcactccagcctgggcgacagagcgagactccatctcaaaaaaaaaaaaaaaaaaaccacataggctcagtcttttcagtatctgctttactggttcagtaaaagccaggaaacacaactttgtggtaatctgaatgttattgaactgtattttgttcactttattgtaaatactagtgaacagtgaataaatggttgtatattcctaataagaaaaaaaaaaaaaaagacccaaagtacagcgagctgatgccgatctcatttcgcagaggtccgcctgctctcccctctccaagagtgtaatcctatgcttaataaacttatgccgctttgctatgtgtgtgtatcacacccaattctttgttcgaaacaccaagggcctggaacttcacagctttggctggtaacggggagcaggggtaaagacatttaaaagctgcttgtgttaaccataatcgccatcccatatatcagacccccagaactaactcatcttataactgaatattgtgctttttttttttttttttttttgagacgaagtcctgctctgtcacccaggctggagtgcagtggcgcgatcttgactctgcaacctccgcctcccgggttcaagcgattctcctgcctcagcctcccgagtagctgggactacaagtgcgtgccaccacgcccggctaatttttgtatttttagtagagacggggtttctccatgttggtctcaaactcctggtctcaggtgatccacccgccttggcctcccaaagtgctgggattacagacgtgagccaccacacccagctacttgtgctttttgaccaacatcttcctctcctaccacccccagcccctgataacctccacctactctcacttctaggagatcaactgttctatttttttttttttttttttttttttgagtctcgctctgcacacccaggctggagtgcagtgctgcaatctcggatcactgcaacctccgctttccgggttcaagcgattctcctgcctcagcctccagagtcgctgggattactgagccaccgcgcccagccagaagacccacgctccctaagacataacccacactggtggcctttgttctgacttctcacctgtgctccccacccgctagaaactggcttctctccccacacttcctctgaagctgtctgtgtgaccaacactaatgagcttccttcctggaacatgcagtgacccttttcagcccttctcattattgctcccccacagttgtatttgacacgttgaccacttcctcctcgaaggactcacttctctggctttctcggacacttcttgctactcgttttctgacggttacagtaccaacaggtttgcaggcacctccaccaccagagccaatcccagctactcgggaggctgaggcaggagaatcgttcaaacccgggaggcagaggttgcagtgagtcgagattgcgccactgcactccagcctgagtgacagactgtgactcctcaaaaaaaaacaaaaacaaaaacaaaaaaactacagtcttgctctgtcgcccaggatggaatgcagtggtgccatcttggctcactgcaacctctgcctgctggggtctagcgattctcctgcctcagccccccaaggagctgggactacaggcatgtgccgccacgcctggctaatttttgtatttttagtggagatgggggttttaccatgttagccaggttggtcttgaactcccgacctcatgtgatccgcccaccttggcctcccaaagtgcgaggattacaggcccccgcacccagcctaggatcctgcacctctctagcctagcagttctctgctgggtgattttgctctccactccaggggacatttggcaatgcccatggtaatttttaattgtcatgacttggggaggggttctactggcatctggtaggtagggtccaggggtgctgctcagcttcctacaatgcccagggcagccccagatggcagcagcaccaaggctgagaaacactggctcatgcagaaagcaaccaccttacacccttcagtgcagggacaaaggcagggttacgagtccacggaaactctccagtctcagcctacgtaagacgtggctatttttctttcttattgtttttattcatttatttttcttgagacagagtcttgctctgtcgcccaggctggactgcagtggcgcgatctctgctcactgcaagctccgcctcccgggatcacaccattctcctgggactacaggcgcccgccacctagcccggctaattttttgtatttttagtagagacggggtttcaccatgttagccaggatggtctcgatctgacctcgtgatcctcccgcctcggcctctcaaagtgctgggattacaggtgtaagccaccgcacccggccttattcatttattttttgagatagagtctgagccctttattttatttatttagagaccaagtctcgctctgttacccaggctggagtgcagtgtcgtggcctcagctcactgcaacaacctccgcctcccgggttcaagcgattctcccaccttggcctcccaaagtgctggcattacagacacccactaccatgcctggctaattttttgtacttttagtaagtaaagacagggtttcaccatcttggtcaggatggtctcgaactcctggcctcaagtgatcggcccgcctgggtctcccaaagtgatgagattacaggcgtgagcgaccacactggcctaatgtgtagttttttatctgtggcctcccttctgccctcccccttctgagactctgaagcccattacatcactctgcctttgtgtaccaacagcttagctcccactgagaacatacagagccaggcacggtggcggtggctcacgcctgtaatcccatcactttgggggtgctgaggcaggtgtatcgcctgaggccaggagttcaagaccagtctggccaacatggtgaaaccccatctctactaaaaatagaaaaatacatagctgggtgtggtggcacgtgcctataatcccagctactagggaggctgaggttggagaatcgcttgaacccaggaggcggaggttgcggtgagccaagatcacaccattgcactctagcctgggcaacaagagcaaaactgtcttaaaaaaaaaaaaaaaaagtgagaacatatggattctactcctgttagaataatggcctccagctccatccaaattgctggaaatgacattatttcattccttctaatggctgaatagtattccatggtacatagacaccacgttttctttatccactgtagggaccagccccacagggtcggtgggtctctccctgtgtgcggcgacgagagagtgtagaaataaagacacaagacaaagagacaagagaaaaggcagctgggcccgggggaccactaccaccaatgcgcggagaccggtagtggccccgaatgtctggctgcgctgttatttattggatacaaggcagaaggggcagggtaaagagtgtgagtcacctccaatgataggtaaggtcacgtgggtcacgtgtccactggacagggggcccttccctgcctggcagccgaggcagagagggagaggagacagagagaaagacagcttacgccattatttctgcatatcagggactattagtactttccctaatttactactgctatctagaaggcagagccaggtgtacaggatggaacatgaaggcggactaggagcgtgaccaccgaagcacagcatcacagggagacggttaggcctccggataactgcgggcgagcctgactgatgtcaggccctccacaagaggtggaggagcagagtcttctctaaactcccccggggaaagggagacccccccccccacccgctgcccctttcccggtctgctaagtagcgggtgttgttaattgacaccttttgctaccgctggaccatgatccgcttggtgacgggtgtcttcccagacgctggcgtcaccgctagaccaaggagccctctggtggccctgtccgggcataacagaaggctcgcactcttgtcttctggtcacacctcactatgtcccctcagctcctatctctgtatggcctggtttttcctaggctatgattatagagtgaggattattataatattggaataaaaagtaattgctaccggctaatgattaatgatactcatatataatcatatctaagatctatatctggtataacaattcttgttttatattttattatactggaacagctcgtgtcctctgtctcttgcctcggtgcctgggtgccttgccgcccacaatccactcattattcaatgggcacttcggttggttccacatctttgcaattgtgaatggctgagccagccattcttaactgggggtgattttgtccccatgggggtatctggccacatcccgagaggttttttggttgtcacgagttgcagtgggggcaggctcaggctcatccaagtccaggggtgctgctatacatcacgtgatacacaggacagtccttgctacggactgaattggtcccaccaaacgtcatgtacaagccctaccccagatgtgactctatttggacacagggcttttcagaggtaattaaggctggtcaggcgccgtaatcacagcactttaggagttctgtgtttattactggtaagtgggtaagagcccagtgtggcagctcacgcgtgtaatcccagcactttgggaagcgaaggcaaggggataactggaggccagcagttcaagacaagcctggtcaatacagcaagactccatctctataaaatattttaaaattagccaagcatgtttggcatgcacctgtaatcccagctcaggaggctcaggtgggaggattccttgagtttaaggctgcagtgagctaagatcgcaccattgcactccaacccggctgtgggcaacacagcaccaccaccatcttggctgggcacggtggctcacgcctgtcatgccagcactttgggaggccgaggcgggtggctcacctgaggtcaggagtttgagactagcctggccaacatggtgaaatcacgccactgcactccagcctaggcaaccaagtgagactctgtccgccccaccaccccaccaaaaaaaagactactatcttaaacaaaatcaaaatttttaagtagataaaatatttaggggaaaaaaacttcaattaaatatgcagcagagtccgacccagatgttttcactcccagcctctacctactatctttgtgtctttatttttagcaaattctacacgggaacttcatgtgcatgtagaaccctaaatgttgactcagccctacctctcatcacctgaccacttcctttattcacgctgtctctaccacccttcccatcggtgtgagctgtatcccgctaaacactgttaccacccacagcctgcattactaccagctgactgtagccttaaacaccacagtgatctcgagcatttgagaagacttatcttgacaagggctcacgaaagacagcaatgctcaacagcaagataaatgagggccttcatgggatcattcagtgctgaagccactcaacctccaggtttgggttagtaaaaagaactttgtcaggccaggcacagtggctcacgcctgtcatcccagcactttgggaggccaaggcgggcagatcacctgaggtcaggagttcaagaccagcctggctaacatggtgaaacctcgtctttactaaaaatacaaaaattagccaggcatggtgacgcacacctctagtctcagctactccggaggctgggacagaagactcacttgaacccaggaggcagaggttgtagtgagccaagatcgcaccactgcactccagcctgggcgacagaggcaagactccatctcaaaaaaaaaaaaaaaaaaaaaaagaaaagaaaactttgtcatacaagctttcaacctaaagcattagccatatgcccgtgtttttgtgcctgggaccatgacaactttccccatatcaatgctcttattttttttttttcgagacaagagttttgctcttattgcccaggctggagtgcagtggcacaatctcagctcaccgcaaactccgcctcccgggttcaagcgattctcctgcctcagcctcccgagtagctgggattacaggcatacaccaccccacccggctaattttgtatttttagtagagacggggtttctccatgttgaggctggtctcgaactcctgacctcaggtgatccgcccgcctcggcctcccaaagtgctgggattacaggtgtgagccacagcgcctggctgctcttattaaaatagtctcatcacctaccgcaagcgtggagagccaagtgaggagaggggtcagtcccttttggcagcgcctggaagccagtgctaacatcatggtgacaacttttcattcttaaggaaaattgcggagtgacttctatgcattttctatgaatgaccaaatacagggtgtggaaaagctgtgtttgccatggcaatgggaagccgagagaaacggggaggcgagagagacagagacatacacagagactcccagagacagccacacagactcacacagaaacagacagacaggctgggctcggtggctcacgcctgtaatcccaccactctgggaggctgaggcgggtagatcacctgaggtcaggagtccgagaacagcctggccaacattgtgaaaccccgtctctagtaagaatacaaaaaattagccaggcatggtggcacagggctgtaattccggctactcggaaggctgaggcaggagaatcacttgaacctgggaggcgcggttgcagtgagctgagatcacgccattgcactccagcatgggcgacaagagtgaaactccgtctcaaaaaaaaaaacaaaaaaaaaaaacgaaagaacagagagacacatacaaagacagagatagaaacgcccagcgacagagacacacacagagaaacacagacagacacagagacacacacacagaaacagacacagagacagagagacaaaaagacagacacagagaaacaaagagagacacacagagacagagagagagagagacacatacacacacacacagagagtaggaggcggcccgtgggagccgagcagaaccagcgtgaggcagggccatcttctgaattaaaggcaacagtgactgtaagcttgtgctttgtgagtaacaggatagattagaacagggctggctgcccatggcccacgagctgtttctgggaagcctccgcaggtgccagccaggccctgcgctgcttccatgtccaaaggcacagctgagagctgatgagagaccgcggggcccacagtgccaagcatatgaactatctggcccgtttgtcaatgcgtgggttgatcacataagttatgatcacataagtcacaaagacacactgatcacatagatgcacctggcagatagtagaccacatggcgcctgagttagggaagaaaagaaatagaagaatcaaccgaatcatccctgaacttcttagcaatacttcctcctagacaaagcacagagtaccatgtttattgcaggtttgctcctgagcatgtcaataaacgcagctgcaacgagagtgctctaactttattatccctgtgagaaagtacatagcgtcatgtgaagggggtgcgtgactcgtgcagaatctcccaaaaatagtgagaaaaccagtgtcaaatcctacctctcgacagactctagtgttaacatgtgaccctctgacctgcattcataagacatcttagagacccgaatcccgcttcctgtgtaattcgtagagcgatcccaggctgctcagcaaaaaaagtcacagcacggaggtgccgttgccccggaagcattgcaatcaatagtcagcttgggattcttttctttcacttcctccaacagcttcttgatttccaaattagtttcataggtcttcaacctggagggatcagagaacacaaatgttcccagaaattcattctcaactacccaggatgcctgaatatctgttttcaaacactcaaagcaggaaacgtttttgggattttctgggggacagggtcttgctctgttgcccaggctggggtacagtggtgccatcttggctctctgcaacctccagctcccaagttcaagcaattctcatgcctcaggctcctgagtaactgtgattacaggtgtgcaccaccacgcttggctaagttttgtatttacagtagagatggggtttcgacatgttagccaggctggtctcgaacttctggcctcaagtgatccatccacctcggcctcccaaagccatgggattacagatgtgagccacagcacccagtcagaaaagttttctaaaaagaaatttagacccacacaatggggatccttataagtctaagaaaaaaaagattatggccaggcacggtgtctcgcacctgtagtcccagcactttgggaggccaaggcaggcagattgcttgagctccgcagttcaaggccagcctgggcaacacggtgaaaccctgtctctaccaaaaatagaaaaagttagccaggaatggtggtgcacgcctatagtcccagctactcgggaggcggaggcaagaggatcacttgagcccaggaggcggaggttgcaacgagctagagattgccctactgcactccagcctggtaacagagtaaaacatgcctttaaaaaataaatttaaaaaatagataatcaggctggtgcacggtgactcacgcctataattccagcactttgggaggccgaggcgggcagatcacctgaggtcaggaattcgagaccagcctggccaacatagtgaaaccccgtctctactaaaaatacaaaaattagctgggcatggtggcagacaactgtaataccagctactcaggaggctgagacaggagaatcgctttgaacctgggaggcagatgttgcagtgagccaataccgcaccactgtactgcagcccgggtgacagagcgagactctgcctccaaataaataaataaaaaatagtggcaaatcaaaccttcagtagaactaagagaatgccagagtgaaccccagggttaatgatagcaaacttggctctaacgtggctgcagcatgcaagcctgtgtatgtgaacatgaggggtggtgattgtggagacactggcttgctatgttgcccaggctggtctcaaactcctggcctcaaacaatcctcccaccttggcctcccaaaggaggaactgaggaatgagaaaagaaatacgccccaaacatatgacataagagaccacagggggctagagatttgtcaccaatagtccttggtggcattacagacctcggtcccaccaacaagagaagcatgacactatttagctcaagtttcatgatatacccctaaaaccttaacccatttatgccagaggttacaattatttgaactgcagacgtgtgaaaaatcgtaccttgagcaggatataaataactcccacatgcttagcgttccaataatgcaacactgggcatcatgaagcagtttacatgcgtatcatctctacaactaaaataactcttgaataagacaagtgggctgtgcacagtggctcacgcctgcaatccgggtactttgtgaggccaagacaggaggatcgtttgaagccaggagtttgagaacctcggcaacacggccacacagtgcagcagagcaaaacgttgtctcagaaaagaaaagacaaaggcaagaagaaactaaaggtagattacgttaaaataagtcactgaggccgggcgcggtggctcacgcctgtaatcccagcactttgggaggccgaggtgggcagatcacctgaggtcaggaattcgagaccagcctggccaacatagtgaaaccccatctctactaaaaatacaaaaaattagccgggcgtggtggcgggcgcctgtagtcccagctgctcgggaggctgaggcaggagaatggcgtgaacccgggaggtggagcttgcagtgagccgagatcgcaccgcttcactccagcctgggcgacagagactggagtctctgtctcaaaaaaaagacagattcaaaaaaaaagacagactccgtctcaaaaaaaagactccgt

SEQ ID NO: 7 - DNA, 25681 bp, Homo Sapiens
cacgcacagacagatgtacacacacatatgtacacacacagacagatgtacacgcacagctgaaggatgcacaggctttctctggaagtcacaagtaatagtgacatcctccagggaggggaactaaggaatgggaggacagtggcatggcagaaaggagacttcctttgatttgtgtaattgtgtaagaaaataaatgtaactcccaaaagaaacatttttaattttatttcataggtggtaggtgacatagcatgatatacagtaatgaaaccctgttttacgaagcaggaaatgaagagtgcagtcctgctccgccactaagtagcagcgtgactttggaaaagtcccccacccactggaggcctcaacaccttctcatttataactgaacagcattaaactgaatcagtttccttggtggcttctggctctgaaatcctttgatttttctagctagcatctgtaaggcctggagttcttgtgaggctgtagtttaatgtaaatgtgtatttgaattcgcacatacacacacacacgccttcctagaaggtaacagagcacagagttttaatctaggaaaagaggaatgtcaaacccatggccgacaacattctgagaattcactgcccttcgaaccagaaaaacaaaacacaaaaagtttcttagcaaaaattccggccgtatcagaagaactgcactgtatcttatcagaaacacacccttggggctgatgtgcacagtccacagaaacgcagtcctgaaaacacacatcactcacactccctaggagctctgaaaaacagaaagctccagtgtgctgagcaaaagtatttaaagcatttacattggttttcattaatccaagcggcagttttttttttttcctcttgacaagactttaaatgtttaccagcaagcagggaatatgaagataattaataatcatttaattctcagtcccctgggtatttgacagtaaatttcacaaatagcacatcattaaaatatttctctaagtcagtggctgagattcgtcactatttctccttaaacaactgccacgctcacaggcggctttcttacagtcatcacgatgcccgcacggcactgggtgaagttagtttcatctcagaaccaccaaatgttctcaggaggatttccaaaaagcttgctttttttttaaccacttgcacgatctttgctctatccatgtgccaccaaaaagtatttacttaatacttctagtatttaaattcactcacttattttttttttattttaaaaggaaactttacaccactactgcagatggaaaatcaatgtcacctccataaatagaaggtagggtaaaaatacaataaaaataaaacttactaaattcaagcaagacacagtggctgggcaaaggctctgagtctgaggctttatacagccccgcccccgccaatgcttctgcggtataactcatatacacagatgtcagtgttttgagtatagagtttgacgagttttgccaaatgtcatacattcttgctaccaccaacataatcaaaatatggaacatttccaagaccccagaaagtcaagacctaggaacagggaaagggaggagccagtgttagaaagaaaggtgtcaatggtacagcagtacctcactgaagcgctactccttttttgtttgtttgttttttgttttttgagacagagtcttgctctgttgccaggctggagtacagtggtgcgatctcgactcactgcaacctccgcctcccgggttcaagcgattctcctgcctcagcctcctgagtagctgggattacaggtgaccactaccatgcccggctaatttttttgtgttttcagtagagacagggtttcaccatgttggtcaggctagtctcgaactcctgacctcaagtgatctgcccacctcggcctgccaaagtgctgggattacaggcattagccaccatgcctggcctgaaactccactccttctgactagttcaaagagaaaatagcgctgaaaaatagttcttagcacatacaacgtcctcactggtggaccacctaaaatccatttcacctaccatgggaggtacctggcctgcatacgaagcatcagtaccaaagggaggaagaagatagaagcagggatgggggattcagaggttgctgctcaagggcctctgtacctccatgtcacgcacatgctgttccccttacccagaactcccttccatacctcccgaccttacatctcctaacaagccactatttatccatcatgacttgacctgagccaccccctcctggaggccctccctgtttccccaggctggatcaggcagctcttctacactcccaggtcccacagagtcccacattgaagtctatctatggattcactcgtctgtctaccctctagactctgaggttcttagaggcagataggagtcttacatcaataattattatgaagatgattataatgcagaaaaagcagctaaaatatattgagaacttacatgctaggcattgttataagcacattacatgtagtaaattacttgatcctcacagccacctacccactggatgccaatagcagctgccctgtccctctccccgttgtggcaaccaaaaatgtctccaggcatcgccaaacatctcctgccaggcaggctcgcccccagctgagaaccacggctcctggctttagagccccagcatggcacaggaggcctgcgcacagcagaggcccaaagactgctggaagcatcaactcatgactcacgccctcaacctgaactgattcagaaatgagacatcttctcactctcagccctggcaggtgacgctcatctctgtggcagacacctgaaagttctcattcttatcacccctcctttcatcaagttcctgggtgcttacccaataggtaggccctgtgaatatgtggagaaatctctggccactcccaaaaactacaggacaagattgctggggaggccagttcagccctcctctttgccccaccaagcaagagctctacgctgagatccaggtctcagtcaacagagggtagcacggggttaggggactccagatccactcccacccccggctgtgagacttggggaaactccatgtcctcatgtgtgacacggggtgatgacactggtgatgatacaagcctgtcggtttccctaacctatgcaaagcccaagacacacagaatcaatacccagtaaatggggcctactggattattattgaaagaacaatcttttcggtgacaattctgccctttccctgctatagttagtctattttacaacaacttgaacgcactagtccccaaccccttcgaaagcattacgaaaaaaaggaagacatttttataaaaataaaatgggttggtcagcactttaggaattctctttttacctcagatcctgctgaccttcagaaaatgtgtggaggaggtaaaacgtgcttccaacaccctctccattccacactttgtacttttcctcccaggctacctggcagtggatcgactaaatcttactaaagtgttagtgggtcagtgagccgcttgtcataatcaaaatactagcacatctataccacttactttatatcgagaactgtacgcatctagtgtatgttcatatttgtctcacaagaaccctatgaagcagctgatatcgtttccccattttatatagggggaaaatgaggctcagagagggtgagtaatttgcccaaggtcacacagcttctaagtagcagagccaagattcattctcaggcaacctggctcctccacccccctaaccactactttatcctgcatctcaggaaagaggtgatttcctggatggcgacaccctgaccctgacacagggaagcaaggatcccccccggaaaagaaatcactctgggggcctcatcatttcactcgggaggtgggctgcccctgacaactgaagacacagattcctttcttcgggaatgttcacagtctctccttttgccccaggattgagtcaaagattattttaaaaatccactcaggccacacagtggtccccgccagcgcctctccccctggaagctctgtgagcctgttgctcaccctcgcagacggacacacagccaagtctgaggtggccgctcgctcagcgccaacccgccagccaacagatcacttttgaaaaaaggaacagcaagagaacatcttctctgcctagaactgcaggcgggtggaattttcgggaagcagaatcgtatgaccaaaatagaaacccagctagggaacctctgagaggcagccgtccttggggggcacagggaggggcagaggcaaatggagctttcaggcttgagtggctgggaagagagaagcagggcctggcctgggggctggatgcccctccgatgggcagcagggccacagggctccactgatccctggccaagctgatccgacccacggcttgatgagctcaccccgatgccgaggtggcgtgagtcccagggcctgggtttgggacatgacagtctgtcgccaaggcagcacttaggatgccacagctggcaccgcagatctgtagccggaggaaaggggagcagacagagaggcaaacctcgcctcctgccactcgccccgacaactctcataacttcctgcccatcaggggccacaaagaatcccaaaacagagcaggaaggtggacagattcttcatccggcaggtgtgcacaacctagagaaagaacccctttgaaaagcaatgggttgcctccaaataacaaatctgacactcagcaaactttctgacaagcccccagaccactgctgcccacgccccacccagtcacacacatacaccacctaacagtaagtagattctcaatcaatgaatcatgtgtattaatgaccagagtcaggttgtcacacccttcgttcggaggtgacacatacagacacaggcctgaaagtcgagaaattccatctggataaatcaggtccagaaatgccaaaaaggaaagggaggacatttgccatcctgtctcgtccatggaaccactggaaaaagtcatcctgaaggcgatgtctttgctgaccttgccccagctaagacagctgtctgccttccccagacggggctgaaagaaggactcagtggtgccttccaggcaggctgccgcaaggccaggcgcccaggacacaggactgaggtgatccacaagcaatgaggcttgcagactggctctggcatgaccgcttgcaaaaacacacgaacccacgcgctgacacgtattgcttttggataggggtggagaaatgtatggaatctgcaacccgcaggcctcaaggtcaccttttagatgggggcagcagggcccaggcatgtggcacacataaggactcatctccatcttcaaatctggatgggaagaactgtctcttgctggtttcaagccatttcctggggccctcctgccttggagaattccagagatattcctatttttagtcattctaatagcttatgtccactgtgccgcaagctttcacgtgtacgctcccctgttctctctgcagtttacataaacccctggagatagctactccgaacacctctgtgttagagatggggaaattgaggcttggggtgcagggaaattcccaagaccacaaaaagtcagggcaaagcttgcattcaatttcagggtgggggctgcagcgggggccagggggaggggcagtgcacagggggaagggctgtacatgtgtagcatgcacgtgtgtctatacaagatctgcagattccatcagttttgtttgtttttgagacagagtctcactcttgtagcacaggctacagtgcagtggcgcaatctcagctcactgcaacctctgcctccagggttcaagcaattctcctgcctcagcctccctagtagctggaattacaggtgcctgccaccatgcccagctaatttttgtatttttagtagagacaggatttcaccatgttgcccaggctggtctcgaactcctgaccttaggtgatccacccacctcggcctcccagtgctgggattagaggcctgagccactgagcccggccttcattaatttttaaaatatgcatcacttacatgaagtaaaatgcacaaatatttcacatacatcttgtgcctttgcatatatatacacacactcgaacatttcaagtcccccagagggttctctgtggcccccctgaagccagacaccctcgcccaggaagaaccactccctgacttttctcaccatatgctgggtttgactgttctcgaatgtcccataaataaaatcatacaggatgtatatgtctcacttatttggctcagcagaatgtctgagcttcacccacattgtgtgcagtagtcctttcttttttattgctgtgtactatttcactgtcaaatccaccacaatttatccaatcaccttgctgaactccctccgtttttaaagcatttgagattaaactcgtgatttagcaaggtctgcgtctaacagaagagagttcaatgcatgacagagaacagacctcagagtggcttcctcaccaaaaggagaaggaaagatttggtcagaagagttccccagaaatagacttcagataatcctcctgcaacaggactcgccagggctaaacccacccactctgtcaaaggcctgcagaagatgacatgagcaggggaacatcccttctttccatcctctgcccaacttagcaaacagtccctctctccgaccagccacctctgcgagtttggtctcttactgatccccacatcccctcgcacagcctgaaaggctgatttccatttttctttcagccaacctaaaatccaagtggaaacttcccccttgaagacagtggggcctgtgtaacccttggccggggtcagagatttaaaattaatgccttcttgactgacagcttctttatttatacttttccccaggagctttcatttcagtgccatgttcctgggggtgggcacacttcatcagtggcccctgccaaccccctggttattaagacattcctccctactccatggcaacagaggtgatgtcacccattgtggattttagacctgcagcgcaccttcttaggattatacaggtaaacagcccctttccataacctttaaaataactttagcaggcatttcagacttggggttttttttccccctcatttaacattctcacttttgcaggcatgcccaagcaggtctgttttgataaggaccttcataaatcctgagctttgctggccactttcttcccttcagacccagctgaagaaatgctctttttccaaaacctcagattacaaggtcgggagggtcccaaataccaacccaggaaaagcaatctccccactctgcatgtggcttacagtctgcctttggtatatttcttccacagagggaaaaagcattaaagattcaagtgcagggctttagatccaaatgcccaggaggcaggcaggaccatccaccgggatggagaaagaaacagaaaaatagcagagctccctgtcatttctcatttctaccttagccaggagttttccaatgagtataatcccattaggacagtagcaagatacaatttctaattatataaatatcaactataagaggtgaacgtgcacacatcccaccgtacatgagacacatcagacaaagctagagacagcagctccatacggtgtcctgctgccctccagggccacatcctggctgtgagatatagtgctgatggcagggacctagaatgctcagtgcccaagttcaaggcctgccctgccacttaccaatgcaaactctcagcaaagttaccttacccccaagaacctgatctcactggtccaggatgcagcctgagaacttctaatgcagccaggactgagagccccttgccacccattctacatttttcaaatgtatttaacctgccacctgatatggctggagagccttgagaaccaacctgaataacactgctttaaagttttaggagcctctactcctgatcaaaatctatgccaccaaaagaacacaggggcttgaatttagaagccaagatgccacgtgtttcacagggaagagtgagtgaggcaacttcatttcctctgcctccctgcaaggccgatgctcagttctagccctcatttcacctttccagctgcacctggagacgttatttgtccaaagcaggcttattaaggcctgtctttaactcaacacagaaggcaatgtctctgaatgtcacatgtgtttagtgaacctgcttgcttagtgtagaacactatttttagcaagcaccaaacacacacacacacacacacacacagatactgtatcacagcacctcatttgtccctatttgtttaccagactgtgacccatattggcctgggggccaggggaggccagacaccatatctaatttgtccctatgctgctacagggcctggcacaaaaccagcattcagtgtgtttgctgaaagaatggggttttaattgtgccctgtgaatgggtcgagagcaggtgttcctacactgaagtgccagtaaaattagggaatgggacacagaagggtctgtgagtgctgagaaatgacatcaaaagcacgtggggggatatgagagggagtggagaggggaggtggggatgtgtgggtggggggtgcagggggtatgtggtgagggggcagtgcccaggggaaagggctgcccatgtggagcatgcacacgcatcgtgtgtgtgtctatagaatctgcagatttcatcagctttttaaagggctgtgacctcaaaagtgtaaggatcacaggaatagactctataaaacaaccagcagtgatcagaaggaaccagttttcctttctgaaaggccgaagttggtattaaatgctttagcttagcagaaattgaaggagggctgcaccagactgttaaggcaaagcagatgtgagcactccccacatatctgtccccaacacagtaactggagatccggcatctctggaggtgaccagggattcccagtacccacccgtctctctcagtgtattacaagttgggagaaataagagtccattgtattcacaagcatgcataagggaattcagcttctgaactgtctgctgacagccagcacatcttccccttccagggtgggatcagtggccccatcaggactcccacatccttgcccaccgggtctttctgtcactgtgtacttggttgtctcctccactagaaagaaaattaagagtcttctttgcacatctctagtgaatacgtttgaaacctagacagataaaatggataatttcccagaaagatagagtttacaaaaattgactccagtagaagtagaaagtgtaaagagaccaattcccacagtatagagaaagccatcaagaaacaactccacaaagaagcaccaggtccaggcggcttcacagaggaattctatcacagctttagagaccagggagtcccagggagacagaaattattcctgagcttagaaaaggaaagaaacctaaacctgatagcacaaaaaataggccaatatgaatatcactcatgaatactgaaaaatgcttaaatattatctgatgccacaaccaccttaagaaaataatacaccaagtggagtccataccaaggatgtcttcatataaagaaatctaataatgtatgccaacacattaataggtctacgaagaataagatcatatttttccatagatgctaaaaaagcctttgatataattcaactcccatttgtaataaaaactctcgggggaaaaaagaaagaactaatacttcctttacataattcatacacctcaattttaaagccaacactggagtcctcctccaaggcaaggatgcccactgtcttcactatcatgtaacactctactggaggtattagttaatgcaattagacaagagaaaacaacagaggcacaattagaggcagtagctcagagaggacaggatctgggtctcattccccgttgtgaccctaggatctaacacagagggtgctcaatagctgaatgagtaaataaacaatggctcatattaattgaacacctccattaacaaaagcaagggtttactaaaccactagtaacagatcacatgctgtgttgatttaaatgggttaacctattcaaggcaggtaacggtcctatgaggcaagtggtattatttcagccattttacagataagcagacagatgtccagagagatgagatgacttgctcaagatcaccttgttggtaaacaaggttttcaattccagccctgccatggtcccagacaccttgctaactggtttgcatgtgtctctcaccaaatgagagaatgaggaccctaacacaatagttcagaacacatggtatggagcaacactgcccattttgggaaaattactttacctctctgtgccttagcgtcctcctccataaaacaggggtgataatagtgcctgcctcctagggttggagtggaatcacatgggctaatgaacgtctgctacatgctaaactccataaaatgagcatccgacctccccaaaattccctaatttaccttcaccaattctatcaacaatgtctgccccattagcagtacctttccttccttggtttttgccaagctcgtgcccagagttaaggatagaactttacatgcgtcaccaatatgttgccatctgggacaaaacctaataaaaagattaaggctagtgttcacccctgaggagtcccaccatacagaagcaaagagaggtgactgctattaacatctgggtgacccagagccagatgcacatctggggcagttcacattagcctcttaaagcttaccatgtcccttctctttttttgtctggtttgttggtttgagacagggtttcgcactgtcccatgggctggagtgcagtggcacgatcacggctcagggcagcctcgaactcctggggttaagagattctcctacctaagcctccgagtagctgggaagctgggtctacaggcatgcgcaactaggctaggctaattgttttatttttttatttttattagagatgaggtcttgctatgttgccccagctggtcttgaagccctggactcaagcaatcttcccacctcgacttcccaaattgttgggattgcaggcatgagccaccactcccggccacagcatcccttctctttctgggtgctaactcttctgtgctgcctacttctcagcaaagagtaagtgctttccagattctggagtattactctgtactccttaagtgtgggcttcatgtagtaatgccttccaaagagtttgaagaaactgagaaaagctacctctactgggtaatcaaggttagcattaatgataaatgacatggatagtatactttttgttgttgttttttgagacagagtctcactcttgtcacccaggctggagtgcaatggtgccacctgcctcactgcaacttctgcctactgggttcaagcaattctcctgcgtcatcctcctgagtttctggaattacagtgccttccaccatgcctggctaatttgtgtatttttagtagagttggggtttcaccatgttggccaggctggtcttgacctcctgacctcaggtgatccgcccgcctcagcctcccaaagtgttgggattacaggcgtgagccaccacgcctggctggatagtacatactcttgatacgatgtgatgagaagggagctttatctttgtgggcttcctcccgaaaacctagagccctagtctaatgaagggacagtctacaatacaaccaacactcctcaaaacagtgaaggtcacataaaacattcccaatctgaataaggcataaacctcagttaataatgtgtcaatattggtttgttggttacaataaatgcaccatactaatgtaaaacattaataacacggggaaacagggtattgggtatatgggaactctctgtgctatctttgcaacttttctgtaaatctgaaactgttccaaaaactgaagttttttttttgtttttttttttttgagaaaacagattccagggctttcattgtggtcatttagatacccatctggtggccaccaagcagcacttgccaagaaaaaccataaaaagtacctcccttcagatttggcttggaaactatttccccggaaatccccccaccccacccgacaaggaaaataaaagctgattaccaatctgggaggggtgtgagtattcgttccctgaaaaacatgactttaatcttaatgaacagaaagaccacggatattagtgcggatcgtttgcagattcttaattgtatcttttcaaagcaaaagatgtcctccagattgcaactctagaagactggtctcttctgttggctaattgtttccatctccagccaagacacaaaattattactaatgaccatctctgggtatccaagggaagaggatacccaaagctaaagcaaacccctcacctaacgtggccagagaggacaccgatggaagcgaaaacttcattatctgcctaacacagtgtttgtgggaaacatcaggccaccaagcctccttgacaggcttcctccacgagccagtcagcacaagcccttcctacacactagatggaggcaagcccagagtgcgtctggaagctactaacaggcctgccactgagccttcaacaagcattggctgggctgggctgggctgtcaaaatcaggaagcctggttgggttttttgttttttccaagacaacctgctaaccagaaatacacagtgaggttgggcgtgtggccgcttccccctcctcctcctcctccctctaacgaatgctcctgttaaacacgtgaagtgacagataagcattgggcccagcccggggaagtccccagcccccagcaactgagggcagttggaggcacagagtgacaaagttcaggcagaaagagcctgtgtccttctgaatccatgctgcagctgcccctcaccctaccccatcccaccacatccattaggactaagcgtagaagatcacttaatatagctcagaccaatcctcttgtgagtggtaagtgatgggttcagcagcagaacccagggaggaaatgggccggccttataataccaaaggttttaaccctctccagcatcagacagacaacctcttcctcagtttcaacacaaagtccccgtcaaccactgctcacaggaggtgatgggagctgcgtggcctcacttcagtgcctggagggaaggagcggcctcctacccttgataactgggttcagctgcaccccccttccttctttttttggcaactcctccctgctaactccattcttcgcttcctcacctcctccctccaaaggcacagaaatcatgtcccttgccctttgacagcccagtcccaggcaagaggccagcagacagcacccgccccccagccttgggacctgcctgccaccttttgttttgctgagagtgaccctcagggagcagtcatgagcaaccagaaactggtgcccctaaggggcaagagggagccgaccgccccctaagggtggcaggggccactgacgcctcccctccctggcacctgggtaggggcaccctccctccaggccccttaggaagggggacggctggagccaagaggactcctgtgcccagtccccaggcctgagcccctggcgggctcaggggccaggccaggggtagcctccaccgaccttcgttcggattcaaatactcatagtcgaagaggatggagaagtcaagctcgtcttgggggctgcccccaggctcgtggcctggggcgtccccgccgtcgggttggggctgccgctcgggggcgttcatggcgcgcagggcgggaaggctgcggggccgggggcgagggcgggcgcggctggctctgggacccctcgcagtggggctggcggaggcggctcgagcggcggggtccctttcctcgtagggacgcacgccgggtccggggacggcgcgcctggcgcagcgggtcctggacgcgcccggggaagctgagcggcggcggcgacggcggcgcgagcttcctgctccggaggcacctgttgcagcccggggaggcggggggggggggggcgtggaggcggggacagggcggccaggccggcgggggcggggccgccaccaggggaccggaggggaggggcgcgcggcctgggctggccggtgccgggaggaaggaggctgtccgcggacctgaccacactgtcccgggccaccgctgggcgctggggcggccgctgtctcccaccctccacgggtgagtgcgacacgcgctgcgcgaaccagggtctagacaagaaagctgccgccactaggacttttgccctaagggacccactggccccacactttttcctgcttttcttctccatggggtggaagggggtatccacccccttctattgcagacccgtgtctccaggcgtctccgtgtgcccacgggggcggcatgattttcacagtacttcagacacctgcatggccctgaactcaactccccagcgcctaggaaggaatcggactgacagcactagtcccccccgttacagctatgcctcctggccacctaccacgtgccaggtgctgggcacccagccggagccagacactgttgccctcggaagctcaggctctggtagtgggagaggcctgaaggagagaaacaggacaaaaagcatctgcttatggggccaggagagaactcaccagggtatgggataaaggttggggtggctttagtcccttgggtggtcaaggaggacctctctgaggaggtgacatttgaagaaacctgattgatgaggcgatcttggggaagtgtgttctggcagtgagaaccaaaacacagagccagagctcgaaggggctgggtgtgctggagggagaacgaggagtacagttctgatggggcggttggcaagtgacaaacacgcctggctgcttgtttaaagcatgattcccaggcccctccctggagcttctgattccataagtctgaatacagactcgtgaatgtgtatttttaattaagcacccaacgtgagcattaatgaacaggtacatttggcaaacactgcataaggacccagtaactaaagaacaccctccaataaaactctgccagggggctccaccaacttagctgaagttggaaacagactcacagaggtagaaaagatcaaaacagtggtcttcaacccttcccacatattagaatcacctgggacacctttttaaactcccgtgctgggctgcaatccaaacccactgaagcagaattcctaatttttttttttttttttttttttttttttggagacggagtctcgctctgtcgcccaggctggagtgcagtggcgcgatcttggctcattgcaagctctgccttctgggttcacgccattctcctgcctcagcctcccgagtagctgggactacaggcgccagccaccatgcctggctacttttttgtatttttagtagagatggggtttcactgtgttagccaggaaggtcttgatctcctgacctcgtgatccacccgcctcggcctccccaagtgctgggattacaggtgtgagccaccacgcccggcctgaaaatttttttaaacttcagatgaatctaaggtgcagccagtgttgaggatgagaagattagacgggagaggtcttaagatcctcgtgagaaccacagcttgacctcaagtgattcgaatccttccccatgtgccaggaggaattgaggacacgcattcttcaggggagccatctcagctccattaaggggatttgtgccaagccatccatcattccacaaatatttattgagcacctgcctggcactgccacaagatgttggggatgcaaccatcaacaagccacagcctctcccttcatcatgcttatgccctgaaagcaaagtagcacagttatgaacggggttttcaaaattgcactcagaccagtggttcttaacccagactacacattagaatcacctggagagctgttaaaatttgtattcaacgacctgagcaccaccagacatcgatttgatcagaatgtttggggttgggacttaggcatcagtattttgtaaaagctcaccagatgcttccaatgtgtggccagagatgagaaccactttggtttagactcaaactctactgcaggggcctgggggctggctcaggaatcatttcagagtcttgggcagcacctcctggttgtcagagcataaagaaattccagcctttgtttcctaactataagcacttctgtgccatgtgtatccaacaagcatcttgggggcagctgatgcatttaggtggaggaaggaagagtgaagaccccagctaggatacttatagacaggtatctagaaagagatggattcttctgggtccttatgacagggacccaaggtccagatgatgaaattttggccaataaacaagaaaaccaggcttcccctgtgatttagaaaaggagaaaagctaggaatgcctccccacatcctttctcgtccctccatcccataattattaagtgccactaaatctagtggacatttgttgattgtgcctacccagaataattcctcccttcttctcataacagcaccccagtgtgttccttggggaaactactctaaacataatcttggtagagctatcaacccagctgccccaccttccccaagcaacgaagtggatgaatgacccagactgcgccaatcagagaattttatctccactaactagcctgagatccactaaggcaggggctatgaccacctcattcgcagctttatgtgcaatggatgtgtggataaatggaggatggataagtagatggattgatggatgggtgaatggaagatggatgcatggatggaagatggatggatggatgaatagatgggtggatggatggataggggatggattgatggatgggtgaatggaagatggatgcatggatggaagatgggtggatggatgaatagatgggtggatggatggataggggatggatggaagaatggatggatgatggatggaggagtggatggagggtggatggacggatggatggaggataaatggataaatggatgaatgaaagatacatggatggattgatggaggatagatggatgaatggatggatgaaagagtgaatgtgttgcacggatgagtggatccattaatcaatggaagagtagatgtttgcctggatgaatgtagagtttgactctccttaaaatccttagagttttctttaagggtcctccaccctgaggcttaccctggccacccaaatgctatggcaagaacctaaattcttaccccaattccacttcctcttcagatacccaatgataaaatgagatattaaagggaagatcactttgcaactgatcaagtgctacaaaaatttcagcctgaggcaggaccgttcaggacagtctaactgcctttgttgtccctctgaacagtggatatattttcaaagcttctaggatttggagtctggactattgtagtcagagttctttaaaaggaagtgcttcagactaggtgccaacccataaaagagtttctgctggacagtggggagtaaaagggtcttcttccctaaaggttaccttgaagggtgggagtttgggctgggggaaaggcatattttcaattcaaaaataaataatctgtgctcttaggaacaaggtccaggagcagaatgcatgagctttatgcatcgagagtgactctgggaggtggagggatggaggtgggatggtgatcttcacagggcatcgctgtcaactttctctctatcctgtgtctgacctcctttggacaccctggcctctgagtttttccccagcctctccaaccgaagtgcaacagaaagctagtgaagccactgagactttgaaacttctagcacacattggtactatttgaccctggcccaggaactcagctcccttcaacatgcacttaacccacagtctaattacagactgaggtatgtgccgtgaaaggcaaggagaatgtgttacagagcttatgtcaaggaaacctgacgtagacagggaattcagataaggctgccctagggaggcgatgtttaagctgggactggaaggttggtagaagttagttagggaatgatgaggggaggtactaacagagcgatgagggagtatgtgtaaaggctctgaggcaggaggaaagtatgaaacgatggaggacccgaaagaagacaggagtggcaggtgctcagggaaggatgagaagatggtgtaagatcaggctgggaggtaagtggggcccaggagaccatgttgagagtttgggacctgaaagcaattgggaacaactggagagtgttaggcagcacatgacagaatcatagacgagtttttagatgatggctctgggttctctgaggatgagaaattgcaggggcaagggttgaagccggaggaccaagtagatggttcttatagccgtccaggaaagagataatgggggcgtagactacagagacaagtggtagccatagagataagaaaatgtggaaggattcacaagactcatagactgtcatcctttggtccctctgtgagttacctctcttcctcttctaggcttccttaaaatggagcataatttgggtccacctggatagaaacagtcaagaagcactgactcccgaaacgccttcaagaagctcctcctaccacccaaggtggctctgcgtccccaggctgcttcaagatggccctggagttacccaccacctacagctctgccttcctttccaccttctggtagaaagctcatttttatctacaacctgggcctctccacagaaatccaggcttgtatatccaatgacgacccaacatctccacgggagcatctaacaggcacctcagtgtgaatgtgtccaaaaccaaaccctacgtctccagctgttcctgcctcactgtgcctcaactcaagtattgctctgcctgtaatccagttctccaatcaaacaccaaagagtggttcttgagtcctcgccttttctcatgcccacgtgcaaaccctcagcaaaagcaggcagttgcaccaaatgtaacccaaagccacccatttctcactaacttcactgttcttcctcccacctcccaagaattcaggccttcattatttcttacttggacaactgcagaagcctcctccctggacttgctacttctacttttgcccctatgtggagcaaccagagggagcctttaaaaaatatacatctgataaaccctccagtggcttcccattaaattaaaattaaatacaaagcccttggtctgcaaggccctacgtaagctacgtcccacctgactctccttgggtatcatctcctgccattctccccttctcttactccctctgccaccctgatcgtccgcctgttccttgataacgcccacatgaccccaccccagggcctttgtacttactgttccctcagatattgcctggccactaccttactttgttcatttcacagctcaaaagtcacctgttagagaccttccctgcctgtcctaataaaaatcgcatcccccggcattctctgtctcctcaccctgcttcatgttcctcattgccctttccgctatggtgtattttattcatatgtatatttcttttattgcctgttcctttcacttgaatgcagtccccacaagggcagggatatttgtctgttttcttccctgggatatctagggttgccaagtttagcaaatacaaatacaggatacccagttaaatttgaattttagacaatgaatgcttttcttagtagaagaagtatgtccaaaatagtatgtgggacagacataaactaagaagttattcattgtttacctgaaattcaaatttaagtggacatcctgtatttttatctggcaaccccagctgtatccccagatcctagactggtacccagtacatggtagcttctcactaaaaagcagctgaaggaaagaatggaagaatggcgcccaacagagcttctacctgagatcaatcagtgaataaaactgcaccactaggagaacccaaagtcccttctttgctcagctttatgggactcaacagggatgtcctgaaatttagcagtgttttgtagccttggcagcccagcctctagcctggttccaatacctgtaattatttgtagagaaataacatgtcatctgactcaatggcttcagggaaattctacctgcacatgttgcttaaaaagaaaaagagcctggtacagtggtgcacacctgtagttccagctacctggagactgagatggaaggatcgctcaagcccatgagtctgagacggcaatgtgtgacaatttcacctgtgaaaaccacagcacttcagcctaggcaacacagcaagaccccgtctccaaaacaaggagtgagagaaaaaaaaagaatattataaaagacaatgttctgttatagaaaatatgtaaatagcttcttgaggttttttggtttttttgtttgtttgtttgtttgtttgtttgagatggagttttgctcttgttgcccaggctggagtgcaacggtgcaatctcagctcaccgcaacttctgcctcccaggtgcaagcgattctcctgcctcagcctcccgaatagctgggattataggcatgtgccaccacacccagctaatttgagttctttacaacaagactggtacatatgaaccccttccaccccttccaggctgactttcctgctgaaggtcaatggcatgaagacataaatgtctgaccaagcctggagtgatcttgtgatacattaaagaacaacccagagctgggaggcccaggatccaaactgagttcttcctctcactctgtgacctttaagcaagacaccttcagtgcctcagtttctctgtctgtaaaatgggaagagatgaattagataatacctgagttaccatttcagctctaaaattcaaggattgtttaacaaggaaaaccaagctaatctgagtagcagccggggctcgcttcatgggatgtgacatgcagagtcacacggcattccgcacctggaataacctgtgcttagaaggagcctgcacttggttgaatgctctgctgttgacattttttaaattctgaatactttttgaacaagaggcgatgcattttcatttcgcacaatgccctgaaaattatgtagccggctctgatagtgtacaagtgctcctcaacttatggtgggtgatatcccaatatacccatgatacactgaacatattgttgggttgaaaatgcatttaggcagggcatggtggctcacgtctataatcccagcactttgggaggctgaggcaggaggatggcctgaggccaggagtttgagaccagcctaggcaacatagtaagatcctgtctctatgaaaaataaaaatacattagccgggctcccatttgagcccaggagcttgaggctgcagtgagccatgatcgcaccactgcattccaaaagagtaagaccccatgtctaaaaaataataataataggccaagcacggtggctcatgcaagcctgtaatcccaggactttgggaagccaaggtgggtggatcacctaaggtcaggagttcgagaccagcctggccaatgtggtgaaaccccgtctctactaaaaatacaaaaaatagccaggcatggtggtgggcgcctgtaattccagctactcgggaggctgaggcaggagaatcgcttgaacctgggaggtggaggttgcagtgagccgagattgcgccattgtactccagcctgggtgacaagagcgaaactccatctcaaataataataataataataataaatacaaagaaaatgcatttaatatgcttaacccactgaacaccatagcttagtctagcctaccttaaacatgctcagaacatttacagtcacctacgcaattgattttaggcaaaataacccaacacaaagactactttataatgaggtgttgaatatcttctgtaatttattgaatactataccaaaagagaaaaacagaatggtttatgggtacccaaagtacagtttctactgaactcatatcgctttcacaccatcgtaaagaaagcctaagtcaaacatcataagtcagagaccatctgtataacacataagtcacacattttcatcatgaactccatgtcctaacaacctcccattataataaaacactgcttataaaaggcaggcattgaaacgttttaagttggattcaaaaagtgggaacattctttaccagactccaaaaaccatctcccttcaacggaagcattccctgggactcatgatcactctaggtgttaatatataacttatacacagatgcatttgactccagcaaggctggcactaaggtgaggcaagagaggtaaaatgaaagagggcaccaaaaactcagtaattagataaattatatcttcacaccatgttttaaaacatcaaaatgaatgcaaaaaaaaatcctcgctgaacaagctattataattttaataaagacagggtcagtaacagtccatgtgagccacactgcaccctaaggccacagggaaaatgagtaatgttgatcttgtctttatttaacatttttatttatttattttttttgagacagggtcccactcagtcacccaggatggagtgcagtggcgagagcatggctcactgcagcttcaacctccccagctcagatgatccgctcacctcagcctcctagtagctggggctacaggctcctgccaccatgccctgctattttttttttttttttttttctggagagacaaggtctcactatgttgcctaggttggtctcgaactcctgggctcaagctaccgcatctggcctttttaaaaaaagcttatcatggagttttggcatgataagccaaaattttaaaacaaaaattttgttttaaaaatattatattaggtcgcacacagtggctcatgcctgtaatcccagcacattgggaggccaaggtgggcggatcatgaggtcaggagatcaagaccatcctggctaacatggtgaaacccaatctctactaaaaatacaaaaagttagccgggtgtggtggcgggtgcctgtagtcccagctactcgggaggctgagggaggagaatggcatgaacctgggaggtggagcttgcagtgagctgagatcacgccactgcactccagcctgggcgacagagcgaggctccatctcaaaaaaaaaaaaatgtgtattaaaatatggttcatcctgggcttacgcctgtaatcccaacattttgggaggccaaggtgggaggatcgcttgagcccaggagttcaagaccagcctgggcaacatagtgacaccccatctttatgaagctgaaacaggaggatggcttgagcccaggaggctgacgctgcagtgagccgtgttcgtgccactgcactccagcccaggtgacagagcaagtacctgtctcaaatatatatacatttcatatatgtatgtgtgtctgtgtgtgtatatatatatacatatagttcatcctgattactgaatttcttgcattttgctcccccaaatgcctcattggcttcctcatgctcttgcaaagccatttttagggatgagctccttatagattgagaaaacaagacagtttcaaacctgacttgcactccaatctatcatctcctacagagtcttttaaagcccgaagaggacttctctgttgtgagaaaactattttccaagaggggattgcagcaaaaggccgttagttgaatatgccaccctcccactgggcaggcactgatggccatcagtacctcgtaagacagcagggttctactaaaagccaacacccaaatcaacgggtggactgtaggaagatgccccatttgacagcagtagaagtcacaggtctgcaggagctccaccaagtccatcctgcaggcatattatgtttggcctgcccagtaatttatttttaatctgaactaatatttttattttttttaattatatattaagttctgggatacatgtgcaggacgtgcaggtttgttacatcagtaaacatgtgtcatggtggtttgctgcacccatcaacccatcacctaggtactaagccccacatgcattagctatttatcctgatgctctccctcccgcaccttcctggcaaggccccagtgcttcttgttctcctccctgtgtccatgtcgaactaacatttttaaattgggagatttcacataaaagtccaaaattccaacttcttaaaaaaaaaaggcaggcagatcccgccactccaggcctacattcccgtatggaccaatcggctggaggtgagtagaggctgttccctggggatgccctcctccgtttgccccagcccccacctgtcttcctcattcatttgttccacctgccgggagcctgtgagcttgagcgcctgggctgcagagtcttgattccttccacctggtccccgcacaactactttgccctggttttgtttctcctctttgttccttgctttctagcacgttcccctctgtcttgggtaaaaacgtttagaaggagggcaggcgtgctgggcgcggtggctcacgcctgtaatcccagcactttgggaggccgaggtgggcggatcacgaggtcaggagatcgagaccatcctggctaacacggtgaaaccccgtctctactaaaaatacaaaaaattagccgggcatggtggcaggtgcctgtagttccagctactcgggaggctgaggcaggagaatggcatgaacctggaaggcaggagcttgcagtgagccgagatcatgccactgcactccagcctgggcgacagagcaagactccatctcaaaaaaaaaaaaaaaaaagagggagggcaggctcagtaaacctgcctcccccttaaacgacggtccttgatcttaactgaacaggagatgccgccatccctctgccagggaggctccatcttctaccaaggtagaacctcaaggggcagggtgggtagggctggttcgttaggggatagagtattggttaatatctgcccatccccacaatcatttctcactcaatgtacctgtcaccgtcggcccactgtcccccctcagtcacccaagctgtcttcccctgtatgccccaagatcatttctctctccattctcttccctgccatattctttgcagactcaaacatctgtaccgatttcctaatctttgaagtcagggagtgatgaggacaagctggctgactcagaggtacccgtcatcagctcccatccgcacaactaaaccctggagcacacacccccaccgcctccaaaaaagcacaagacatcg

SEQ ID NO: 8 - DNA, 21954 bp, Homo Sapiens
gagcggctgggttcgtccctgaggccggagtggagatgaccgcagccagggtggccctgctcaagttgggtcagcagagcaaggttccttccagagggcttgcccccgggacaacttggagcctgcttctggggagccacacacgtcctctcccacttcttgctggagacttggggacgtgaagggggggttctgtgatcccggaaaaaaagtaacttctcttggtaggtgatactaggcagttgcgtcccggggagtccccgcctttctgcgcttcccctgacgggggcacaggggccggcgtgcgtgtgtgggtacgtagctcatcccggggagctgggatcctcttttccgcacttggggaagacgaatgccgaccattggctcagacaccataccacacaggcatttctggaggcatttcgcggcgttattatgggaagttgcgcggaccggggccttcgcgctacagccgaggagtctcagcgcctgccaggcgggagccgcacttccggcgaggtgtcttcgggagggggcgccacagcccgtggcagtgccggcctcccgccttaaccagcccgactcccgccgcgccagcaccgtggggagcgagtgggtcccgcccggccgcggcctggacctggcagccgggcttcgtgggcgctctgagccgtggcccgtggcgcggggtgatccttgtgcctggcgccggcctcagaaccccgtttacggctttccgcgcatacggaggttgctggggaccccgacacctgcgcgccctcgactggggcccgctccagcagtgaagacccaggcccttccctgggccgtggctgctcttggtgcctcatgggagcgcccggggtagggactcggctagtgacctgtaggacatgaggggcgagctgggagccgattcgcccacggcgtctccttcgccatggaggccccccacccattccactccggggttgcggccacgcaccataagagcaccttcaggtctgagctctttaggggtgggagtaggcagttcgtgagtccgggaaggcctgcggggtttcccgcctgctgcggacttagcgtggggccgaccggggctggcgagggctggcgaggactggcggggacccgcggggctgagccagctctcgcgaagccctcaagtgaggaacggcgcttgtggctgcgcgctctccgcagccaagttgcagggtccagcaggggctcaggtcctgttccctccgcagatcccggatctagggctctagtggtctcggccggagggaaggtgacgcgcagtgggcgcagacgcagagtgcggggcgccgaacgtgggaaggagcgggttcagcgcgctggtgagagtttcaggaaatccgggagagggcggtatttaccagtcccttccccgagagcaaccaggcaaatcggggaaggttagaggtgggggacctgcctgagccgggacaaaaaactttggagctagggccttctaaccctggagacttgccgactccggggcgggctctcgcactcaagtcccgagatgggatgattttccaactttcgtccagcctctccttccgctcccgccgctctgctagcactcccgcactctctccctgggtcacaaccctcgcctgcggaatacctgtctgaagggcgcgtcagtagaagcttcgtttcatactacctttcttactgttctcttcatctaaatcgcaggacattattctcggcttcatttccacatagcattcggcagtggacaaggagtaggcggacccgaacctgaacctgacagctgatgccgtgaagtggacacttgaagttcttggtttggctttagggagcgtttagggaatgtgttaggcagcaatcgggcaagcatgagctgtagcccaacccttccctccgtgggaaaattcaagttaggacgcaatgcgaggcctcttaaatctttaagatcctcgggtcagctcaaagagtctttagcaattcgttgttttgtcttgagaccattatcggtccctaagcacctaattatttaatggcagccctctgggtatatcgggtagactgataggtcttatctaacattcaaacacaagtttctggaggaaactctcatctgacttcctcctttcccacccgccgcccactgtcatttattttattaaatggaacccatttaaaatccaaatttataattattaaaaagcagtcttattacatattcttgaagatttggttgtgtacgatcatttaatcatgtagtttaatttctgtgttgttcccacattgccaacttgatggaggagagcagacccgaggacttttcaacctccaataaaaaagaagaggactttatggctggggtgaaaaggggctggtgagctacgacaatggggcagcatagctttactatgtgcaaaagcattcagacacatggcgacccttttgcaataaaactttattgatgatcgtttgaaagttatggcaactccaaggttataaaacttgtcataaaataccaagcagtcattagtttacctgacctcatttcaatataaacttccacaaaacattttattttgttccttcttataagtggagaaaagaagttgaagaggttaaatacagcggcccattattgaggatccaaaatctgcaatttgacactctgaccttcatccctgcaaataaagcagtaaaatttacattttattctttaatgttccgttattgcagaaaagttaatagtgtgtaaatgttattgtagaaaagataataacagctatgttttagttccaactgcccatttttagcacataacctgtgtttaattttggatggagactttttcctctttggaagatttgtaagatatatttaacaattattaaagaatatttgctccccgagctatgcaatagaagtctaagaagcaaatggccacatgttgtcatgtgacctgaagagttgttcaaaatattcaattagtatttacagctattgagaggttagatgactaatcactacctcttgccaccctcagtcatgagcttaaagaaaggcagctgccctgagattggcacgtacaactatactacagaaaataacccaaactgatgttccaagaaagctccaggagataaactggagtttgtcaaaatcatcatttctggtccaactgtatgagtggacttaaaccatggatcagagaacagccacagaacactgataactttgagtggcttctcatcgctccaaactccactttggattggctgaagctcgtgtttccttaatgctgtgtagctaaggccaatctacctgcttttggggatttgtgagcaagtacagatggcaaaggttgactttgtgttagctgcatggtgatttctccaaaacatgtaaaagtctggatatactttttcacggattgtttaaaatataagctccaagattgatccaggcatatatgcatttatgatgggtttaggaatctagatgaagaaagctaactctttaggacctcgctggaactcttcttggtaatgttatgcttagtttcctggtgtgctttcaagtatttcatggaattttaatgagaaaacaacattttaaaaaccaaaatcttatgtaaaatgctgctttcttctagggagtgtatgggtgcagagtgtgtgtgtgtgaggggggtgagagagagagaagaaagagagagaaagaaaaagaaagagagaaagaaaaagaaagaaagaaagaaaaagaaagagagaaagaatctcagagaaaggaatagggatgaagctaagggaagagagaagtattggataaagtactataaaaagcaaactctcctagtgtccataactttctctagttggctggtacagtttgcagtaattttcattaccgtttcttaatgccaggttctcagacacaagtgataatatgcatcaaaataaagactttgtgtttccccaagtcagtactgacttccagggaggacagggaagaaagggcctatggacctacaatgcagcccataggctgaacacatatctttagcagacttaagaagcaaataaggggtctaaattcagtcctttgagcttgacatgtttctgaaaatctcatactgtgggttatcttcagagataagttgacaaatttttcttataaatgaattgattaaatgtattgtgacacacatatatatgcaaacttgttggcaatatttgttgtagcaaaaatagcagtgaatttaatttacaatgtttatatccctctgctattaatcccagcattcatttgggtttccctagatgcctggagtggtgggagtggagtaaggtaagggagaaaaaatgtcttctctttaatctttgacaaaaacaattccctctccccttttcatcttccttctcaaaatactgttcttcacccaagaaccagctattcagactctctatcttgattttcactgttgtcacagtaatatataatgatccccattctgctctacctaagtattatatttaccagaaagttgtggttatcaaagaagcatccatttggattcacctttctgaactacccctcttatactatattctggggaaggcatggaaatgacctgagttgatttctaaagtgtttttcatgtcaaaaaatcataagggacagtacatcatgcacacacttccttttcttatattctgttttgttcaaagacattagaaaatgttcacgagacaccatgtcctccttcaaatactttcctgagttatctggttaattgaggcttagctgtataatgagaagcatgtcttcaggagggctttaaaatatatgtttgggattttttttggacagctgggtgatagagttgtgaaatcccaaattatgccttgagttctggtgacacgtccaggctgcctagctttgccttcatcatttttattgacacaaaaaatgttcctatagaggaaaaaaagtgcagcttttatgtagtgatatccaagtgtatgttattcattccttttacaaaactcaatgtatattttgccctaagggtatatatttctccatgagactaattgctctaatagaaataatgatgtctcctatgtacctaatacctttatcccccaaaaccctcatgtgccttagcagttacatgatgaaacacacagatcatgtgcatgttgtggccagaagccatggctcaacttacacacaactctaccaggttaaccctctgttttctgtgtgtgtgtgtatatgtgtgtgtatatatatatacgctttgatgtaagagaaacagaaagtcttaagtaattttgtttcacagccaaaatattatagataagtctggttgtaaaagaaaactcatacttttagctactttaaaattgaaagaagaggtagggaagactttttctggaagttataatccttatatgagctatgtctgaattttcagaatacaatttaaataacacatctttctactgactgtattttttcctcttgggaaaactggatggataaatgttaaattctaaaataaaaattggggaagggttgaagaaaatatacctacttacatcaattaccattgaagaacttcattttgtatcagagttggagaaatgtatagcactgatctagaatgctacagctggatttagagagttttaggtacctggaaaatcttcgaggtatttacggtgtctctctcttgttttgaattgcttttggttacctataagttaatttgctttctttaagttttaaatccatttgccaatgcatgcagtatagtactttcatctagcaagaaagtgctaaaatctactggcatgaaacattcaaactgcaaatggaaaatctgcccagtcaggtggtgctccagcatttcccctttaaaacacagcagcagcagtgcctggttgctggaactggttgttggctttgctggggaggcttgtaaatgtaccatgcattatacagcctgggaagcagggtgatttggacagactaaaagaattttgacttttctatgttctgactttcagggatttaatttttagccttaaactggcattatgaaggttttttacatggagtaatgggatcattatttcttttcctagtgaaaggggtgtctccaagaatggaaacatgtggcagggcagaactcaatcccagaggaattgaatatgaatcactcaggcaataaaaactgctaagggaatctgtgttgtcagcttgccagaacatcagattcacacctctggtcctgcaggaaggtgatatggggcttttcaaaggtcccctgtggccatgaccttggttttctatccttctaaggagtggctcactggtcagccaatgtattgggctggcattttgatcctgcaggaaatagaactagccttcttccccaatcctctatatccaccctaggagtctgacaagaatggtagcctcagtggtatggctgcatcatgcataggacactggtccagcatttctggtgctaatctctggttttgcaatccttcctctcccccctgcagccattaaatttacagtctgaatatggcatagaaacagaacccaaactgtagcactttaatgcgtaagaactgcagtaaacagaactgtaggaattggaacaatacacgaaggattagtattgtctaaaaacccttctttatttttctaaattttctgctcaagagatttctttgtcctttttgtctactatgcccttccttgctaattagtctgatttttattaaatgtcctgccagtaatatgatttttattaaatgcactaccaaaatggattacgcaatgacattatgaacttaaacatctttaagatttaaaaatgtgtaggtagcttcactgaataaacaacactttacaaattattttttacctctgtgcaaaggacagtgcatctgttgaagaaaaccagcaacacttgcttgattcccgcccccaccaaaaaaaatgggctaattcatattaatttaaaaacattttattgatgaaaaatgtgaatcatatgcaagcagccttttccccccctctctcgttagaaaaaaacacaacagtttgtacctgctggcaaaattggtttactctgcaaagatggtactgtgttttacccctcctggcttattaaagagttaaacacttttgaaattatatttatttcatttttacatttctcttccttagcctctgtgtgtccattgaaaacattgttgggtcctttaacaattttcctagaactgccttccaatcgtgtccatggagaggtggttatactctgttctcccagtggctcagacacgcagcttgtctagaaagccacagccgctgtggaggaggtaagaggtcagctctttcgttggtcctggtgagggtaaaatttttaggcaggaggagcactgactggcaaagggaagaggaaagggttcgccctggaccccacaaatccgcctcttggagcaaacagcctgcaggtagaggggcctattagagcctgcccagttcccgggagggccaaccccagccagtaagaagacctgaggcgtaggatccctgcgcaggaggttgcaggaatgcccccgctagccgcaaggttcctgctggcctgtagagctttcgtgatccccgccaagatgcgaacagtaaggtcctcgtatggatcgcagtttttgtccgaaacctgaaaacactaacttgggatttcgcagttctggccctcgggcccgcctcggaggcgcacccccaatccccacggaacgaattccgcggctaaaatgcattttcccaaggcagtaaaagtgacccctgcacctaacaacctttgggctttctcttctcctgactaccacctctcgcagggtgcgctgaaatctctttatcgttatcgttttttataaatgaaatgatttatttattcgctgtttgcagggaatgaaaggagttgatcctgactccaagatgcattccaaagaaagaaaacgcaactgtagcccggactccgcggaggaaggccaactgactccactacgtgcacttccgagccacttgggcccagctagctgtgttaattatgggttctaattttattgcaactcggcacctcctggtttgttcccactatagtggtcttaaaaagaaacacacacaggcataccccagaatgaatccccgggaaggcaaaggtagattttttcggtgcttgagttgatgctctgagagcgcgctgagagtctcgggcatgtcttggcactcttggaaacaaattgcagccaagagcacggttcttccggtcctctccttgctcctctgtgcgccgctcggccgcgggactcctggaacatgttgtgcaccgcccgagtggctgcggacctcacctcgacgccctggatagccggggccaggaggagacgagcaggcagtctcccgccctcacctagtcagctgcgacctccgcggcgtggactcttggccagcagtgaggaggacaaggttgcagatcctctttgctgcgggttctgggtccggccttgggcggcattctgtcttctaaagtgtggaggtgggtagaagagtgtccactttcagtgtagacacctgaggtatgggggcttctttgggggctccagcgtgagctgctcctgcagattagggaaatggagagaacaacaatggggacatggtggaattcagatttccccctgttaattaacaatatgatttcgcttagtccaagtgtcttctgtgttcttatttaatgtctcttgtaaaatgggaactagaataatacctccttggtatggttgttgtgtttgacgtgagccctcaacaaatggtaggatgaactggagaagaatgggtccatcactccccacacccttccctgcagagcttctttgctgtctccagctctcccgccctgacgcaaggacagctcacaaccagtgtccttgagtagcccctgggggccgcaagagaatccgcccggtagggcatagaagatgggttttcggtgaatcgtgaaaagacatgatcgggtttcccttggagcatggtggagaatgatgcggagccttggggtcaatggagagttgagggtgcagagggatctgaaagggggaaccaaaaatatcgggctttgaaattctgtggattttcaaaggcggttcccaaccttgtcaaaaactacagtgggtgcgcgatctaatctggctcctataggtggcgctgtgacaaggtgcggtggccgggagaggcggctgggggactcgaagactgcgggaaattttctgcgactccgacgctaacccgctgctcccagcctccgcttcctgttttcgagggattagctaggactgtgcaacaccagtctccgctctcggagtcggcacgggggctggtgggtggcgggatgaactcggggaaggcgacaggctggaaacgcagctcctcgactttgcagcgcaccaaccccctatcgccccgtccgctgctcaggtgcgaggattcgccagacgccacaggactgggggcgactcgcaagggcatcatgccacctagaggaaacgcgcagtgagtgagccctgggtcactgaaaatgggagaacgttcgagtcggtcaagatgactccggcctgcgagttgattcagactcctcggaagccagaaattgggtctagagtgggttggtccctccgtcagcagttcgggcccagccgaagcttggggcctagagggcagacgtccggctctgatcagagtacagcgggctgggcctggcagcctgcaggcaacctggaccttgcaataaagctgcattcaacataactcagaccacagtgggagcccccgaagggcttcatgtgagtcccgaaaccagagtttagaggcgcggcctggttctcgtttatcttttccagacagcatttaggccaataaggtctttgaaaggaggcagccccaaagccctcaggccgacacctgagggcagggtctcaaacagctgtgcttgaagaaccggcaatcttgcttttcccacacgcagctgcacctctcctgagcgctgcagctgatggctgtatagtgaccacggactgcgtcctcctcacgaagctgcgcaacttctgctaatgctgcaaccctggcaagacgaaatccccctccctctggctagatcagcccagcctcccctcagggaccttcctgcccctccctacccctccctacccctaggccgctccccccttcctctgttgggatccgatccttgttcgctcttgcaatcccgcagcccggagttttgccccgtgcattaaaacatgttctctttcatttgcagatttaataaacaaacgtaaccatatcacatggagctccacactgtccttctgaaagcaattccgctgttgaaaactgaaaaatgggtgtaatttgctttcagaaagtaatgttagggtcacggcaatttctcgggccgttatttatttttactttaaagtctttaggaaagatttgcttatatgctcggaaaacttccaaatgcgcgaataccagcaatcccgctcgccttcaacgcgtggggtaagggggggtggggaacaattactgagtgacgctaatatggggaaactgaaaagaaatgtcgattgtttttattgtaatagaaggagtgagcaaacagaaaaaccaaccccgggtgatcggaaacaggcaggcggagaattaaaagcgggtttcagacagcaacaggcccctcccctgctctcgcaaggagaaagcgggcgacgagcgctcgcagcccgtggggctgatcccacctcccgcagggctccggtcgtgtcgctgtcggaccgcagaacgccgggacgcatttccgagctcgggcccgacccaacccgctgccattctagctacctagtggagccgcggagagactcttgaaccgtgaggctccttgatgagaaggtggagaggctgccgggctattctccgagcatcttccggccgagctctgctcctctccgtgcgcttgcggcttctccttgggctagcgcgtccgcagtccctccaagtccaggccgcaggtcagtgtgcgggcgcctcctgtcctcctctcccaccagaggacccctgagggctgtctccatccccaatccccgcgactgctccttttagccgccatcccctcccgcagcgcagatcctgcaggggccagcggtccagggcggaccctccctcgccctgggcgcggggcgagcttctggctgtcacttgccgctgcagtttcagggaaactcagctggccgcttaccctgcaagacggggacatagcagagggccgagttctggagaagctgggcttgtttttctctctgcaccgcgcgcaatgccccaactgaccctgaagggtcttgcctttactgcatttgcccccagacggctagaagtcaatgcactatgaaaatcccagtcccggacctcggactctggctgtcttacaatccctgcaactcctccgagtggacaagaggcgggcaccgtcgcctgggcctcgcttggggggggggggtcctgtccccagcagggggcaagttggaggaatcagctccttaatattttctgctagctctgcttgtcataactgcaactcggaatagaacaacctctctcccgtgcatacgcacccccaactctcgccctatcctcccatccacagtcatcactgacctgtagacccggaggagcaggcttccgggggtcggtccaggttggggatacagggaggggtcctcgcgttccgcacaacctgtagtgcttgggtctgacttcggcagccctcgggtacagtctgccgggctagattcccgttgcttctccgcgtctctccgcgggccgctctagcgccgggaagggggcgccgcaggtgactgcccgcggcactgggacggctgacagatttatggagacttcacagcatctggctggggtccgcgagggcagggcggagtccggtcgatccgatgctggggtctaaagcttccccagccacacgcctgggccgagtcgcccccagagtccccggcccctgctccccttgggcgggtgtacacaaggatccggccagcgccgagtgtactggttcctcccacccagtgtagccccctccttcacactctcggcccggcttccagtctcccactgagtaaatatttatccagagagcgagtcgcccctcggaggaggcctcgacgcggctagggaaaggctttttggcttctccctggcctgagccagctgcaggccttactggtgttttggttttggtcttaaatttctccttttagtcgaaattcttccgatctctttgagatcttctgagtccagagtgagcagtgtaaccaggcggcagactccagctgacccttgttcttgttctaggtcctgcatccttacattcatcgggactgaccagaccttagtgttctctcttttccttccttcatcctctttctctgcctcagatccgtcgtctctcggtcggtctcagcgggtcgctgactacctcgccctagcactcggtccgcgccccgggaaggcttcagcatcaccctcttctgctgggatcccgctgaccctgtctgcagcttcggcttctcttgctcccagagcggggtcttcggcttgccgcggatacttagtggcccaaaacacctaaaattgactcttcctgcgctcttgagaatgccaagagcacccagtacctgcaaccgccggcatgagtggggcctgcggggagccgccagagctgcggacaggccccctgcccactgagttgctacccctggcacgcccaggggatccgcagcagctgaggccacatggtcacagccaagttcagcaggtggaaagggagagatggcattgaacctatgtgagaactgggaagatgtgtggcagctgaaggagttggtaggaacaagagggagttgtatgttacctccatataaccagagctctaaaccatatcagtttctgaaccagtctaggctggtgctgcagaactgctaaagctctcgcagagtccccagaccccccgcgggacatgaggtcttgcctgttcgtatgcgaacatccttgtacccgcctagcagccctgcagactgcaaattttccctgggtgcacggaagtagagcagatttggcgcagaggtcgatactcactgcctgtctgtgaggggggaggaggattccttcctggtcaagttgccgggcatgttcattccctcccgcaagcctaaggcagagtcataagctcccctacgatgcggcaaagtctcaactaatttatctaccagccttaagaaggagctgctgcttctaaaatctttagatttccgaaggctctccttgtgtaaaaatgccaggcggtgccacacgatgtcacccaacaggtattggaggtcagaccaggctgaaattgctatcaagtcaaacttcaagaagattttaaacatttgaaaccaaccaacaaaaagggacaagttcaagtatgtctagttgtgggatttcccccaagattccgattctaaagagtggtgttttagttcatctttacctttcacatcctccattctgttaggtaattttgaatttagagtgcatcctaaccatagaagtgggaatctggagatctgttcctttgcagaagcatggctgatcatagttttttcctgggttcttgcaacttactgacctgagatctgggaccagtcagcttctctgggtgtagaccgcagccacacacatccctggggactgttggggaagcagcctgaatcctgtgtgcacaaggagccttctggattgtcaagtagcagtaacagagttcacgaccccaagcagtacaaactcccaaattcacgaaaatatttctcttcttgtttattattttgattcacattctccacaaccctaactgcaaatattaataactttggctgcaaaaaagcatacggtacactttagattagacttacagtgaataaaagtgaaaattcagaagtaggcagaacgacagggcctctggagcttaatggaagacgagggaattacatccatgtgcagcgtcggtgtccactgtcttgggactaagtctctttcatatttaaacaaaactctttcgagagggctcgctggtttggagaaccctcacaaacgctgccaccgagggccaggggcccaggacagtggctgaatgtggcagagccttgggctccgtagtgagtgccccacgcactggcaattggtcgacttggggctgtgcgctagcgttagccgcctgtggttcagttccccgcacacggcgtggcccgtgcctcgagcctgtgtggctagtggttggccggtccacctggactggggggtcgccgcaggaagctggcggtaggaggaacctccctggccttaacagtggcccccacctgtggctcgggctccccgcaacctcctggtttctttggccggcctatcttctcacacctgcgctctcgccacctggcatggactgaagtgaggtagaatcggcaggtgacacagatcctctcctgacagtccccagaggcccgcatgacagattttgctaagacaactccctcacccctgtgcacggtggcgcccgcctcccacctatagccttaacttcaattctgagatgtccatcgttccccggaggaggtctcctcgggccccttctcccttcgagtcattcacattcagaccaaacgctttcatttgtttattcagcattttaccagcctgattttgctgtctttttgtgccgcttctgggaagatgtcaaacacccattttcattgtatttagtcacccaggtggggagctagcctgaaagagacagcggaaggagtttcctggactgcgctgtcgctcaccgacccgcaccaatcaccatgcagcttgccctcggacccgccccttttagggcgtgtccccagtgagtgatagacggagccgccctgccctgctcagcccagcccacgttgctgcttagattgaaatgcagaactcaagcctctttcatcggggcacagacttccttttacttcttccttttgccctctcgcctcctcctcctgggaagaagcggaggcgccggcggtcggccgggatagcaacaggccgggccactgaggcggtgcggaaagtttctgtctgggagtgcggaactggggccgggttggtgtactgctcggagcaatgggtgagtggcggcgggggactctgtcagagccgggaagggagggagggagcgagcgggcaagggagggagggagggagggagcgcgagggcgcgcgccactaggcgctcacattctctattgactttgctcgtgttcctacaagttgtaggaacacgctaagggtcagcggcgcacagcagttcaatgtgaacgctggctactgggtggctgttgatgccattttctgattttaagagaagggagctgtggcatcagcgagcccctcagcccgagtagcaaaccaagttttgtttcacacgcgcgcacacatgcaaacaaaacaggaaaagaaaagaaaagaaaacaaacaacaacaaataaaacaccctctagcttcccctagactttgtttaactggccgggtctccagaaggaacgctggggatgggatgggtggagagagggagcggctcaaggactttagtgaggagcaggcgagaaggagcacgttcaggcgtcaagaccgatttctccccctgcttcgggagacttttgaacgctcggagaggcccggcatctcaccactttacttggccgtaggggcctccggcacggcaggaatgagggagggggtccgattggacagtgacggtttggggccgttcggctatgttcagggaccatatggtttggggacagccccagtagttagtaggggacgggtgcgttcgcccagtccccggatgcgtagggaggcccagtggcaggcagctgtcccaagcagcgggtgcgcgtccctgcgcgctgtgtgttcattttgcagagccagccttcggggaggtgaaccagctgggaggagtgttcgtgaacgggaggccgctgcccaacgccatccggcttcgcatcgtggaactggcccaactgggcatccgaccgtgtgacatcagccgccagctacgggtctcgcacggctgcgtcagcaagatcctggcgcgatacaacgagacgggctcgatcttgccaggagccatcgggggcagcaagccccgggtcactacccccaccgtggtgaaacacatccggacctacaagcagagagaccccggcatcttcgcctgggagatccgggaccgcctgctggcggacggcgtgtgcgacaagtacaatgtgccctccgtgagctccatcagccgcattctgcgcaacaagatcggcaacttggcccagcagggtcattacgactcatacaagcagcaccagccgacgccgcagccagcgctgccctacaaccacatctactcgtaccccagccctatcacggcggcggccgccaaggtgcccacgccacccggggtgcctgccatccccggttcggtggccatgccgcgcacctggccctcctcgcactccgtcaccgacatcctgggcatccgctccatcaccgaccaaggtaggggctcagaggctgggcgtgtggatgtgcagcgtctgcccccgcactctcgcggaggtcccagtatctgcagcctcagggacactgtctttcccaccacctgaggctttttcctttggaaacgtaaggagtcttcctagggggtgttctgatctcattaacttgaaactcatgcccctggtttccttgccacacacagtcttctgcctcatctcaaactaccagacccataacatccccccatccccaacacatggttcgcattttccaccctcccccgcctctcgcgccgaggcagcctcagcccggcttgctcacttggagagtgcggccggggctggacttggggcgcagcccgggaggcccgagcctgcttggggctgccggctgcagactccgctgtgggcagagcagcttgcttggggatcactacggccgggagaagtctggccgggaggagtccagcacgccttggaaattgaagtattctccgattctggtaatcaggccaaatttgctcaggcaggaagttcaaatgtcacctaattggtttcgttcttatgcttcacttcattttcctcggaaatggaggtcccgaagttactactagtaacttgcatgtaactcattcccagacgaagtcatattcacattctctctctctctctttctctctccattcactttctaacttaacagacttcactgtatatatcttaggaagggaagtggcatcagccactgcagtgatggagataaaatgcaggcaattccatgctgtccttttactgttcttttcagttttccctgagcctgccactttcctttggggtccccgggtccccgggtccccgagaatgcaagtggatatctatctagttcctgcatgttttaagcagtgccaccccactgtttctttcctttctcacccctgaccttgcctagtcctaagcgtcctttctgccttgtcagaaggattccccgagccctcctgcccagtccggcttccgcaggagacctgagtttgttttcttttactgagtttttttttttttttttaaggcgttaacttttttcttggtagggagaaaagaaagtctgaatgacctagatgcagaatttaaataatgtgtagatagtccactttcttaatttctcagcctaaagttttaaaagtgtagaggaaaaattaaataggaaagggggaaatagtttctttaattacttcctgcctttcttggttgccaccacattggcacaattatctttttaagtaattaaagcagggctctgatttctcatcttcttgttttctgactgcaagtttacaagagcccagttttgtcttatttggagctacttggagccatagttggagagagtttgcccttgatttataggataaactgacctcactgacatttaaaggaagcccctgttcatgggaaagtgtgagatcagcagaaatgggggctcacagggggatctcaatttcttaagataacttcaagcttgtgcccaccgactgccttttgtctgggaaggcaaagacagacaggcagttctggaccaaaacacagtttcctggtgcaaatgggactcaatctaattcttgggggtggtagaggaggagacatagtgaaaaaaaaaaaaaaaaaaaaaggctgacagagtttaaaagaaaacttttcctgcctagggatcctaccatcagagcaaatgtcagttgggaaagtattggagaatggaaaggagcaacttttcctttcagatattattgtgattttggatgccagctttaaacaacccagtttgtgacacatttgtgattataaaaatgatcatttctacaaaaatgctcactcttttaaagcactgtgttagatggaagtgtttaaaatcaagttacaatggctttgccaaaccactcctccacccataggacccaaagacaaacatacattgtttgtagccttcacatatctctttgaaactatacctggtcactgaaaaatgccaataattcaatattctcaaccccaggtattatagtaattactttacaccatacaattttctttgcatctccaccaagaacagaaagaataactgatggcattacaccttaacacttaattttactttcattttcttaacctatttcattttctctttcttgtatatacattttttaaactctttcaggaaaaccctgccactaacacccatggcatgtatagtggtaattgcaagatttatttttaagtcatatgcacatatcacatatgtaatgtgtagaggtagtgtatcaaggggagccctatgcacacacaaagcagaaatctgtgcatgtatattttgcactgtatcgtgggaataatttagttatttgtttgcaaaggacagtgcaggtctttttgttctctattgacataagtaccagatccccacagtgcagtgagcaccagtgcaggcacccttaggtcagacgctcctctctttcttttcagccagccccactgccaaattgttgtcaacccccagtcggccttgggttaagaatgaggaggtggagaacggcacgtgcagccttaagggttccttctccgatttaggtttcttccactcctttgccctgggagagcaaaggggcgaagggaaatcaaaaaccggttgaaaaagaaaaaagtgtcttccctcaggcgtgggtcagagaatttggaaaggcctactctgaggggagtaaaacttcaccaggccctgggctggaagcacaggaggtcgcggctgggcccagcgccctcgggaggccaagggcagggagccgacccaaggtctaagccctccagctctccgtcgcgggtttgggtcccgtctcaagagtggggcgcgcgggctgggcctccggcctgacaccctctcttctctccatcagtgagcgacagctccccctaccacagccccaaggtggaggagtggagcagcctgggccgcaacaacttccccgccgccgccccgcacgcggtgaacgggttggagaagggagccctggagcaggaagccaagtacggtcaggtgaggaggcgagggtcaggccaggtgggccgcgtggcggcggggatttaggcgatggaacactttgtgatgggtccctttctgagcttcccgcgagagaagcccaggctggcgtccctttgctgctacgagccagatccttcgtggactggggcgaagcagaggcctgagccttggaaggcggagctggggcctcgacccccgccaggggccgggagcgctcgtcagggcgctgggggtctggggcggcagctccccggggcgaggctctgggaagcgcctccaggcctgtcggcctccgggagcttggggaggcggctcccgaagccctttcggcggctctcgttgggggtagagttaaccaaagaaggcgcttctgaagggccgagcggagcagccctggggcctcagagccgcgccttcacgcccgcgaaacgcgcgccccgggtctcggccccacggtgcgactgcggctgcggggtcctcacgttcggactttctctccggtggctctcggacaaacacgcttggccaatcctgcggagaggggcacccagataaacgtaacaaagctaccattttctcgactaaaggtcacattgtaatctcccaaggaagttagtgagaaaacctcaaattatacggactggctgtggaccgtttaatttttctttccctccgtccctccctcatgtctccaaaggaaaatttaaaacactcgtgtttttattttccccccgagaaaagctaaacaaccaccacaacaaaagccccagatttaagtctaaattcatcaccgtcctggagtcaagagttcaaaactctcaaaaaaccggaccttaaggcaatgtaaggtttccccagcagaccccagtaggtttgcaaatctcttaatcccaaactcaattccaaagcctcaagctattcagttttccttttattattttgaagacttaaaatttttaatgcttttttgtctgtcaaaatcagcttttaaaattaagtggaatttgttcctcttattcacttgaaaaaacatcttagtcattattttctgtaacaaatcccatttccacttcctcttccctctcttattttgttgaaatagaatcagaatacatattagtggctctccaatggcaaataacacagaaaatagcaaggaaagagagcccttttccttagtctgtttctactgtgaagaatgtcaatgagaaatgataaggaagtttgtcattttcttttactaaacgacccacccttaattcgtaatttgcaaagaaaaggcagaatagtacaatggttaggagctccgatctctggctgtacgacttcttaggaaaatatttaatttttagtctctatttcttcatctttaaaacagggaaatgatattcccaacccagagatgttatgagtattcaatgagataatgcaaccatatggcacatagtaagcatttattaagtattgtctgtggttctaagtggcagttaaaaagacacgtgtaaaagtaagtaatatttatcagagtatactttgttctgagagaccatagtcaaaaagcttcaagagattttgttacaaacaatagaaagagtgtatataaagcacctaccatagaagcaagcatttaataggcgctcagtgctttttattaggtcatcattgattggaataacattgtgaagtatagagttgaaaaagtttctaattcccacatgtcattgatgaacccagtttatatatcaagcagtcataatcccaaaaaaaaccctttatacttattatttatttatttattttgagacggagtctagctctgtcgccaggttggagtgcagtggcgcgatctctacttattgcagcctctgcctcccgggttcaagcggttctcctgcctcagcctcctgagtagctgggattacaggcacgcgccgccacacccacctaatttttgtgtttttagtagagagagggtttcaccatgttggcctggctggtcttgatctcctgacctcgtgatccacccacctcggcctcccaaagtgctgggattacaggcgtgagccaccgtgccggccagtaatt

SEQ ID NO: 9 - DNA, 21430 bp, Homo Sapiens
cggctgggtccactcattttttcagatggggaaactgaggaggcaagaacctgtttggagtcctactgcctgagtcccagggctgtgtccatggcggggcatctagggggaaggggagggctcctggcacgtgccgagccctcacggacgctcggcctctggcccctgaatccctctgggcgtctcggatcctctgagccactttgcagacaatgcaaggcagcggccaacagacgagtcccgcagcagctgcgcaggcggcgagtacatgtgagaagtttgtgaaaggcgaccagagaaagggagaggaaggcaagtcaggcggctgcgaacacctggccaggcagccccgccagctgcctcgctgcgcgatggcatcttgagttcgggccctcctatcggggccatatcccattccaccctccctgccccttttccaactctccaatgtggggcttgggaatgaaggtgggtgggggtagctgctggcttctccaagtgcaacctgtgcccggaagcatgcctggagcctggccagcctccggaagcaagaagagaagtaaaacctgctcaccctactccctcggaccctgggcttgggagatgggataactagtgccagcccaggatgttagttaggactaacctgagctccagaatcagataaaccaaggctcccttccccatgctactactgcctaactgtgtggccttgggcaacttacttagtctttctatgcctcctttttttcatctgtaaaatggggataatgatatcaacctcacaggcttgatttggagactcagtgtacaacacttccaaagcatctagctcagagccttgtacataggaaccactccataaatggcccttcttgtcaccatcatcatggacacccccctggccagagttcattaattcaacatgaattacatcaagctcttaatgttgcctggcctgtagacatgggcactggaaacacagacagttcttcaaggagcagagatcataaaacaccacgttcttactaagagataataagggaagatgcaaaagacattggaagctcaaagaaggaaaactctctttgagtctccatgaagcttacataattagggcaggattttaaaataataataataataataataataataataataatccaagtgacaagggtatagactaagtttttcaagttcagagtcccagatcctctgcatccaaaatcatggatgtctattaaaaagcacgttagtttttgaggtcagcatctctgggtgtgggcctgtggtgctgtattttaagaggttgcagatgattcctacacatactaaaattgagaaccgctggcacacaggaaaatgcatctgcccccaggcccctaccccctttgcatctctacaaggctagtccttctggaggatatggtgctttgtgccctgacttcaccttacatgtggcaaatctatgtccctactagactctgagctcctgaagcagtgtcttctgtatcttcaaggccttccacaagactctgctgttagtaggtatttggaaatgcttatcgaatggggaaaattcttccttcaatgccacttgcataaatgcccacatagtccttacatggaccttcacatattttgtttggcccataaatggtatgagtgtgtgtgtgtgtgtgtgtgtgtgtgtgtgtgtgtgtgattgtaatttaatgccatggtggtgggggggggggtgggtaagtgctctctagtttaccacagtttcaatctttccttttatccacccagataaagttgctcaattttattttactagttttgcaccttatagaatttaagtttacaaattctggaaagcatagaggctgttacaaattgccgtctaaggctgtccttccaattgctttttctatggtcttttccctcttttcttctccagtctccagtctgttatctccaaggccttctcaaaaagactggtccttaaggatgggtgttgtcttaccgctggctgcctagaactgccagtagaccttcttagaggggaagatgggaaaaaccctaaaacacatgggaccagacacaggtgtgtttcttgatgtgtgatcctaatgcctggggatgctggagtaggggctggtaaggtgaaggtcaacattggaggcatgtgaggaccagttagttttgctctgtttctgactcatgcctgacctctatgctggccagtatctcccagacccctgagaggacagagcagaaaaagagaatggatatgaatcctttctctcccagtttctaggggttcagcttcacagacaactagggtattatggaatgattatgggtctcagggcatcatgggaccaggcaaaatacagaccagtgtatccctgtgtttcattccccttttccctttgggcttccagcattgggaagaaaacaaagactggtcttaaatcctagtgagtgataaaatactgcattcagctctggggagttgagtgtctctggagataaattcctgacatgctcaaagtatgtttcattcaaattaaccagaatgatagtcttgttaaagctggaagtcttgttaaagcttagcaatcatcttatacagcccactccttgtaggtaaactgaggtccagtcagggtcacccatactccgtgtcagaatgcagccccaaatccagccctcctgcagcccatagttctgatgtgtattctgcacttctagaatcctgccacccttatgctctgtgtcttgttcatgaatctacctcccttctactgcttggcaagtttagagttaactttctgaagtgaatattagactggtgactccttgagtgccaggatggattctgattcacatctgtgtcccagcctttggcatggggtctggcacaatgcagatgttgggtgaatggagagcaaggatccacagtatgcacgtgcagacaaaccgggttccaggaggatgacttggcccacccccactctcacatgctttctctttaagttgaggaagaagagaggaacatgtattcaatgatatcaatgcgccaggcactgtgccatgtgcttatcccagtgcattcctcacaacaatcaatgggaaataaatgatcacccccattttacagatggggacaccgcagtacagagaagttgagaatatctcgtggtctcagccagcaagaggcagaggcgcattttgaatctgaggccagggcctgagcgctatggcaccaggttgtgagggagtttactgagcaccaatttcgtggctcaatgcttttcttcttaccctaactctgaacgtcttcaccagaatccaaggaggcagacagtagtgcaattccatttaagagccgccgaaaccgaggctcagagggctttagcgaaagggttgcgcttggctctaggcacctgggctgagtctttttcccaccatcgcagggcgggaaccagcggagggggctggctcggatggggagaaaagcaactggagggcgccgaggggaagagggagcccggatctgtcagggcgtcctcttggactaagggatgttcccctaaaccacaccaccccacctcgttcagattctgggaaacccggcacgcacataccctgcacaataacaggcagggtgaggtctctaagccccgaagatcgctctctcagcggaggcagtggccctgacgagggggtacagctgcacgcgcggggtttctctccgaaccggagtgcagcgtagtcgaggtccaggattccccatccattattcacgatgtttactagagcggggcaagggagaggaaagaagagggaagtagagagaaaaagaggctaggggaggtggaggcgggcagtgctaacctcgagagccctcaagttccgaaactttgagaaggaagaccaagaggctaaggcgcctgggaagcagcaggccgtcagtaaatatttgtaagatggatggataactgggtgagtgagtgaatgggctaatcattagcccctctgatccttgttttcctcatctgtaaaacgggataacatcacctactccatacggtgggtatgagaatcccatgggcaaactctaaattgtctagcacatattaggaactcttaaacggtagctgttgtcacgaggaatgggcttgcaagctctggctgcccagcagaaatgcactgaaggactcccaggcctggagggccatcctgaacagtcgctattctaaaaaaaatactccacaagcttccttagacgggagggttggaggaagagtgggccaagttacatccctcaaatgaaagaaagaaaggcaagcgtggggaggaagccaccccggactgagaaggcagttactgcccctacctctaccccggagcgcggttgagggaggtggggcaggggtcacctgggcctcgttctggcagcccctcaccctctccagggcccgtctgggcgcttggaggcgcctcctcgctgcgccgcgggaccggactctggtggacagcttgggcgtgaggccaggagcgccctggaaatgggcagtttggcggcagccgggccgacggagtgtgtgtgtgtgtgtgtgtgtgtgtgtgtgtgtgtgtgtgtggtggagaggggaagttggagtagggtcaacttcctgccccagctcagcccagggctacccttttatccaggcagttcgagctgggacaggacggagaggttgggacttttggggtggcatgggggaagggaagtccacgaagaagaaagaatcggaaaggtctggcgggttggagccagcggggcggggcggactgggagaggccaggccaggcccgggtataaaggctgtggagggggcggccgccgcgggcgcagaaaggcgcgccgctagctgctgtctctcctcacctcccgggccgcccctgcgagtccccggcgcgtgagcacgcctgcgcgcgcccgggcccttcctggcaggctgcttgtaagatgagtgaagaagcaggtgggggagaggggaggcagcgagcgagagggcgaggggagcgcgggcgctgagcagcgctcacttggagagcggcaagcaagctagacaagcctgattccatgtcacccgctgccaccctgccaggagcgcgaagatgatggccatgaactccaagcagcctttcggcatgcacccggtgctgcaagaacccaaattctccagtctgcactctggctccgaggccatgcgccgagtctgtctcccagccccgcaggtacgtagtggagcataattaccgctctaaggcacattttttgacaggcactagcttcatgtttttttcatgtcgcccagaacaatcgccgctgtctgaacccctctccttgtctcccccgcgttctctcccggcgcgctctctctctcattcatgtctctgatccacacgtctgttccagcagagccgctgcctccgtattaatttttatgacctgggctttgaggagaggcatctcggttgcttgaaaatgtgttttaatcctgtgttgacagtattccctactgaccgtgctgtgcgccttctcgcttgcagctgcagggtaatatatttggaagctttgatgagagcctgctggcacgcgccgaagctctggcggcggtggatatcgtctcccacggcaagaaccatccgttcaagcccgacgccacctaccataccatgagcagcgtgccctgcacgtccacttcgtccaccgtgcccatctcccacccagctgcgctcacctcacaccctcaccacgccgtgcaccagggcctcgaaggcgacctgctggagcacatctcgcccacgctgagtgtgagcggcctgggcgctccggaacactcggtgatgcccgcacagatccatccacaccacctgggcgccatgggccacctgcaccaggccatgggcatgagtcacccgcacaccgtggcccctcatagcgccatgcctgcatgcctcagcgacgtggagtcagacccgcgcgagctggaagccttcgccgagcgcttcaagcagcggcgcatcaagctgggggtgacccaggcggacgtgggcgcggctctggctaatctcaagatccccggcgtgggctcgctgagccaaagcaccatctgcaggttcgagtctctcactctctcgcacaacaacatgatcgctctcaagccggtgctccaggcctggttggaggaggccgaggccgcctaccgagagaagaacagcaagccagagctcttcaacggcagcgaacggaagcgcaaacgcacgtccatcgcggcgccggagaagcgttcactcgaggcctatttcgctatccagccacgtccttcatctgagaagatcgcggccatcgctgagaaactggaccttaaaaagaacgtggtgagagtctggttctgcaaccagagacagaaacagaaacgaatgaagtattcggctgtccactgattgcggcagggcgcagcgtcgggagccgggagagcctagtgctcatccctcccgggttcgggggatggttatcgggaactccaaggcgtttcctaggcaggttaggctctctcctccgaagccacagactttccccctttgtcccgcctggttgcctccggccttctctctctttcctttctattcccaccaaaaaaattttggcgctgggaaaatattgcagaagggcgggcctgagtgtacttgtgctgtccgtggtgctgaaatttgccctcgcgcaggggccgcacgacttcagagcaggagccccaaagcagaggacagtcaattggcccaaccgcccgaagctagggtgaaaatgccactttgctaagcgcgattaggcaaagggtgaagggataaaaaggaagtgatcaataataacacaaagtctaggatatctaagggggacacaaacatgcactggagatttattagagtatataaaatacatgtatgtttccaaaggatagccttatactcccttccttgcctaaattctattcaccttatcctttggtttggcgtaaattctcataaggtagcatgaagattaggttcagggaaagtatgcagggagttgcgggctccaagttgccattttttcgtggtaagtagggctccaaaacaggtgggcccagtctggcgactgaaaattctgggatcgcttggctgtttgtaatcagctgccagcaccagctctggccatctttcactacctactggtgtttgaggggtaattactgcttgctggagagcgggagtttgtagtattcataaccgttgaggactctctgaccccagctcgctgctcttgccagattgccagctcagcgtgcagtcggctgctggaaaacgactgtaacttctctgcattatatgcaagtcctttcaacacgtctaacctccttgcacttttgttattactgttgttgttaacatcgttcattactattatttatttaattctgcttctttccattccctttatgtgggtgtctttcggtggaagttcacttatagttttgtgagggaagaggagtgggaccatgggcctgaacccttctcaccctgcccctctagcccaaattttattttattttttcgttgtttcatgtagtttgtgtgttgctgtgtgacctttggtttcattctctgaatagatacaaataaaatattaagttttcttttccctttaccccttgaattaacttctaaaataaatgctttatttttcaacccgaatcaaagtggttttattttttctcagaggctaaggggtactagctttgaaaaggatttaaaaaggagaaccccaaagggttgggctgtcagtttctgctgcccagcccccagccatcccttctccccactcctcttccatggcagactcacttggagctcctcgtgggagaccctgcggcttgtgtctgaacttgaggtttcaaggcacttccttccatgcttccctgcctgccatcatgagactctgctcaatttgacttagctagtaaactttgaagccggactaatagaaattcgagcctccaatgcctctgctcactggcagaaccatcctgaggctaatttcttaatttctctaagccttctccaacaagattgcttgtctgcagaatgaagggaccaacgcttatttcacaaggttattgtcaggactaggtgagattgtttatttaagacgtcaactagtgcttgggttttgtaggcaacaaattattttaaaagattcaaagggcttgaaaggaggtgaaataatagaggcaaagagggagaaaagtgttcgctgggacactctagtgggacccactcagagttccaaattcatctgaaattctcatccaggttgttattcactctggggtccacctcggcttctttgtgggggtactgctataactgctgcaaagcgcctagcatagtgccctgtacatagtaggtgctccatagacgccagctccctgttctctttacgctccctctttttatttgcgagctgtagaaacgccttcctgatttaaaatttaatgctccaagtccaggagtcatctgcacatttccctgcttcgtcctcaaagagttgcgggtcatcaaaccacggggccgaaattcggagcagagtgggtttgccctccgcgcagtgcgacaccccctaccgcataagctaacttgcggatctcccccagctccctgggcctcagccctttacccccgccttgcacaacagccccagcgattcctccacctccctctccatcgggtgtcctttaataataaatgcccttatgccattacattatattgtgggttttgaaaatttaaaatacggctgatgcaatattaattgcctatagtggtataaaacacagggcaggagcccagccgggctgcagaggagacaaccgtgagcgtcccgcgccgaagcgaagcgctccagaaggacgcgcttttgcgggctgcaaggtttcctgcaggtaagaagagccttcgcatgttcgggctctggagagaaccggaaatctgcctccatcctcttttcgaaaagttctctgccgttatttatttagtctttttttttcttttaattgacaactgcaaaagtttgggagacttttacggagaggatgagaggagctgcctcctgagcgcaaggtctgctccaagacggtccagtagcactaggtccagtctccgagccatgcctctgagcctagtcttcttcaggcgcctgagacggtgatgcgcaggagtattttcaccagttcctacgtgcaggccggagctgcagcccggtcagcgaagcgctccaccctttccctcctcctgagtgcgccggaacggcgccgtcgcctcactcttcggcttgcttcaggaagcaactggagatgtggtttccccaggattgtgtagtcgcctttgccactcgtctggcggaggcacagacctctcgggggaggggaggtggtactagcaggtctggggtttacacaaggctagtatgcatccgaaccgtgtgaccttggacaagtcatatcgcctctctaagcctctgctgccagctgtaaaacttccccaaatttattttgaagagtaattgagggtgtttcctaagatcacctggagcaggttttcattttcctaattctgtcagcttgcaacacgtacggtccaagactcagctgagagtttctttaacttgtaccaagagaaagtgaagtcagtatttgggggtgtttgcatggaaacctgcatcgggcctccggagggtgggactttgagaactacctggctggaacaggggcttcatctagaatgagctaggcatacacattccagcatgactaaagccctggtaggcagaacttggtggcaggagtcctgggctcctgaacggtgttatctctggccagcgacttcctctctgtgtgcctaagtagtctcagttttgttcactacttcatgtccagcactctgctcaaggtctggcctagagtggcagacactagatgtctgttgaatgaatgaattaggtttttgttttgtaaaatgaaagcaccccttccagccgaatcccctctggattcaagggactgtagggaggaacagagccatcagggataggcaagtctccctgggaatggggatcggggcaaggcggtggtctgcatcacaggctttcattcaaggtagccagtgtccttcttgtttaaatagaagagactgtgcttcaccctttggtggttatgggtacacaggggatgctctgtgacatggcccttggaacctagaggaagagccagggaggggggaccagggagtgaccgctgccctgcccagtgtgcctgacgtttgagttccagttcttttactgtcctcctgagatggaaacagctccggctctggaatggacacacctggggtggaataactgctccatctcttacttaagtgaccttactgctctgaccctcagtgtcctcatctgtaaaactggaaaaactggaaaaaagactctctcaggattgctctgatgattaaatgagatcacgtaaggccagggcctgacacatagtaggcattaatagatatttcgttgctttaaaacattttttgtactcagaaaagtgaaggcactgttgtggggcaagttcagggcttggagtcaagtggaatcaacattttccctctgtgagccacagtctggtcagggtagcagtgcctatcagctctcggagtggttgtcacgggcaagacggaagcttaaaagaaaccgctttgcacactgtgcgtcccagctacgcaaggaacgaagtattctctccctgggagtgcctggtgcgaatacatagctcccactgagaagcttggccccggtcagcggctccaggagcccggaacctcctccctggcggaatcccgggcaccattcagccttttcgaaggctccagacttcgcgctgctcctcctcccgaggaggggcggggcgccagagggcaaaggagaagcaagggtcttggactcctcctccttcccagcgaacatcccttccccgccctgttcccactttttggccccggcgccagaatgtttgagccgaaggggcagaacgcctaaaagccgtgtttgtttatttatttatttatttatttatttttattttttaaatcgaagaaggcagtgaggcctagagagcaggacggacttagctggctccttttacctaaaacagctcttctccaatcacgttatcacaccgcccgttttatttctttcctagtctttaagactgcctgatagcacctacccagttcacccctgcctccctgaactcaacgcagggcctcgcacagaacaagcgctctacaaatgtttgctggataaatgactagtgatgatatctaaaacgtatggcgggattcccctatgcgaggtactgttccaagcgctttagcgcattcgtttgttaattcctaaacaacaccatgagtaggtacaatttttaattccattttacagatgagaacatggaggcatggagagtttatgtaacttgcccaggacaagtcatgaacacagccatttagtggagagacctggcaaaaacccggtgcctttgcttcttccgttctcaagtgagatcacctctggctggggtggggaagcggaccgcctgggagtgaaggaggagcaggtgagtccgatttggcaccagattaggcagcgcgagcagaggaggtggtgggagccgagaacgcccgctgtcctcgccgggcttcggagcctccacgcctttgtgtcccgcgcgccactcgcgtctcccgtcctgtctgtgtgcgtctgttcgcgtgtctctcactcagcccctcttagcttccctccagcctcgcgggcgcgaaactctggcccccatgtgccggagcgagggggcccgcgtccccgggcgcgcgcagagtcgccttcccctctttcctctcttccgcagagcggcgggagcccccgcggtaaccccgccccggcgggcagacggagccagcgaggaccccggcggacaaattagtctccccttcgatcgctcttttccgatcaagtcaggtttcccctgttcccccgacggcgcttccgcactagcgcgactcccagggctccccggctgggtcagggttcgcccgctcctcccggcgcctccggataggggcttcccttcggctgcgtcccggcctgaggagtcccctggaccgcgggaggggcgattgccgggtccgcgcggctcagaatcctccccacgcgttgcttatacctttctttgtaaactgtcagatttctgccccctccctcagttcagccctgcgcagccttgcctgccactggaggcaaactgggacagaaactgcgctcgctctctttttatagactgtatatgtaatttaatatttaaaagattttgagttttaggattacacacacacacacacacacacacacacacacacacacacacacacaaattcaagtgttcatcctgggaaaagtcagatttttgttggacttctttatagatatttagcatttaatattatttttactttgaattaaatggggtgggaggcaccaccgtaatttcattggggtctctggccgaatcccttctctaatttcaccatctttctttcccccactttccttcccgctccctcccaaaacacacatcagtcctgctccaaatcccaacatccgtgcctgtgacagagcctcccccaaggcctgaggcttagctaggctgctcacctcttggcagatatagttaatgtccagccctcataaatcaagaccataaaaagcttactttcatatgcactcaatttctaccaaacctaaactaattgcataaattcctttaggccactcagagctgctctctgggttgggatctgatcaattagtcattaggcactccattagctggggtttaagctgcctcatataaatgtctcctgtcaatttgcttgtaattgaataaataaaaagggtataattattagcacagaggatcaaaataaggagaggtcaattttattcaaatatccttaaaatgtcttaatctaataatcatctaataataataattagaaggcatttacacaccagccactccaaaagtccctgaccatgttaaggaaagctctgggctgagacacaaccaagtgtgtacatctaaagtctgtcaccttgatagtagtatctcctccccttggagcctcagtttctttacctgtaaagccagttggttagaggtgattttcttttctgattttatatagatgcattttatgtatggtcaaattaatttatgcatgtcatttaaaaatggaataatacagaagggcaatttgaccatcccccaccctcaaccatttttagttgcttcttctggtagtgaattgcatgtctaaataatgtatctttggcactatttcttttctcaaaattcgaggtttgtttattaatactttaattaaataatacatgattcaaattcaaaagaactaaaagatttgccatgaaaagtctttcttcttccttgacccaagtcactcagttctctttgttgaaggtaaacaacattgtcagtttcttatgtatattccagagatattttattggctgccatttcttgatttgtcattcttagtcattctgttttaacttcttgctatgatatcagaaaattagggatataataatcttgaatattctttccacaccagggatcataggaagttttatataaaatcaataattaaaaaaatgaattcagtgggcagttgaaaattctgattttttttctttgtttttttgagacagagttttgctcttgttgcccaggctagagtgcagtggtgcgatcttggctcactgcaacctccatctcctgggttcaagtgattctcctgcctcagcctcctgagtagctgggattacaggtgcacgccaccatgcccagctaatttttcgtatttttagtagagatggcgtttcatcatgttggtcaggctggtctggaactcctgacctcaggtgatccacctgcctcggcctcccaaagtgcagggagtcaccgtgcctagccaaattctgattttttttaactaacaattaatttggaggtgcagacgtcataatgtataaaaactgcctactcataaagagggtttatatgttgatttgagttctatcccacctccttctgaatagaattcaaagcagcctatctgttattgctatggaattagacactatatttatagtggaggtacctttatctactggatgcttcagtgcatatggtacttagtttaactacatttccttaaaaatctctttgctccttcatctccaccaagtaagcccacttctctagtgaggggagttttcctttggtgtacacagctatgacagggctggggaaaacattgatgacatcacttaataattcacacctaggtggctgggcgaggtggcacatgcctgtaatcccagcactttgggaggccgaggcaggcggatcatgaggtcaggagtttgagaccagcctggccaacatggtgaaaccccgtctctattaaaattacaaaaaacttagctgggcgtggtggcaggcgcctgtgatcccagctactcaggaggctgaggcaggagtatcacttgaatacgggaggcggaggttgcagtgagctgagaatgcgccactgcactccagcccaggtgacagagcaagactccatctcaaaaataaaaataaaaataaaaaaacaaataattcaccaagggttgggattgagcaccagactccagactgcagaaactccagctgagcacccacgtgggagggagccgagggcctcggaatctttgacagaactccaaggtggtgatcttgacttactgctgggagagatacaaggagccactgttcctgggcttgggttgatttgttttgagccctacataccccttcagtgaattcctcttgtagcaaaaaacatgggttggaagagagtgagctcagggaaacagaatcatgtcggatgagaatacaaatacacaggcctgctggtgtagtgagaaagaatatagaatatacacaaagagatctgagttctaggctttactctgttctgtttgatcttggcaagtctattcacttctcagtggctcagtttcctcaactctaacttgaagaaatcgaactagatagttcagtagttcaaagttggtgaggactcatggaatcccttgaaaatttgaagaaaactgtgtccctaacccagaaataaatgcacctttgtgcactcaaaatttttgctaacttgtagaagtcatggatcccctgactcaacccataaattcctgggtcccaggttaggagcccccaaaactaggcaaactaaagggctttctttatgtgaccatccaaatttagggtcaaatacttataagcactgaaccagtttagcaaacagggaagaattttactgaaggcaaaaataaagtgccaattagatgatgagccaattgccaataaggactccagatggctttgacaaaattatttttcagatcaatagtctccgaagagacagcatggtggagtgaaaaaagcaccacatcaggggtcataagctaggttaaaatttttttaaccggttctgccaacaggcagaattgagattttgagctgggacttccctgccctagcccttctttccctaatggtaaaatgagagggttgaaccagacgatctctgaggctgccagctgtagcattatgtgagctaatgagcatagacactgggatgtcttatgtttatatttattttggcttattttatttttctattttgtttgtgaaaagatagttgtacaatccaagtagagctgggagaagggctatcaagtatgctatctcttgggttcccagaattcaggcttctaagatcattggcagaaacgagatcccccaaatcattacgcgccattgaaaaaataaaaatactcacagtttgtaagtttaaaaataaatggcagggtgggtaggtgaggtggggtaaaattaaaacattttgttagactaaatagtcctggcttagccaagctggtttatcagtaggtctagagagacccagccccatcagtaggtctgggggcagagggactgtggtttgttgtgggctgggcaaagtagtacccaaacctgccccagctctggctggagtccacagacaagaaaatgctggctgggcgtggtggcttacgcctgtaatcttagcactttgggaggccgaggcaggcagatctcttcaggccaagagtttgagaccagcctggccaacatggtgaaaccctgtctctactaaaaaatacaaaaattagctgggcgtggtggcatgtgcctgtagtcccagctactcaggaggctgaggcaggagaattgcttgagcccgggaggcggaggttgcagtgagttgagatcctgccactgcacttcagcataggtgacagagtgagaattcatctcaaaaaaaaaaaaaaaaaattaaaaaaaaaaaaagctaaccagaccacttgttctctgctctcagaccttcatttttctatcctcctgacttgtgttaatatttgcagctgtgagctcattcagcctttggggtctgagttactggtcagattgcccaggtaaaatgattaaaacttggattaccttcaattcttccatccccaactctccagaacttctgtctgttctatgctttttacttcttagttgtttttgcctttggcattttactaccgcttatggctttgtgtaggatggcccaatctcttctattaattgtgttaggttaatgagggaagacctgtatttcttggactgtaacagtagggtttttccatcacaagaggggctttaataatattgactcaaatattttatgttatcaccgttagacgtatgaaatcctagcatgtgagctgggaagagttcttagagatcctctcactggaaaatatgacattgcagttctagggacccaggtatctatatttttcacaatctccctgcaaaaaattatgatttcttgcccagagtgaggaaaagttttcttataagtattgttttttcaaccaaagtgccttacattggagtctgggtatatactctgaaacacaaatcttatgtcaatttttatttcattaaaggtggtatatattttgcattccatgtcaacaacacatctctgactgttttgccaaacatggacgtgagcttgacagcttggactgctgtaacaaatagcacaagcaaggtggcttaaacaacggtttattcctcacagttctggaggctgctaagttaaagattaaggtggccacatattcgatgtctggcaagggcccttttcttggtttacagatggccaccttctcactgtgtcctcacgtggccaagagaaggagagaccatttctctcatgtctcttcttcaaagggcacgaacacaattcatgagagtccatccttatgacctaattacctcccacaggccccaactacaaataccatcacactggggattggagcttcaacatattaattttgggggtacacaaacattcagtctacgagcttgtgtgtgtgcacatccacacactactgtgtgtcatggagtagattgatgcagtattcagaacctttggttacaaccgcagttctgcacactgacatgtggctcataagaacaagtagcccaatttggaaataaattctaatgcaacagttttgttgtagggcaaagatgataactaaaaggaatttagttaatatgtggtaaataacaataaaacgacttttctaccaatcactttaggagaacagctatttaacaaatatttgaacttgagtcagtgaatgagttgttcttgcttactatcctcctcatgacaccctgtccctcaaaaggcgaaggaaagaaatgaattttatttcatttttcttttggagacaggatctcattctgtctcccaggctggggtgttgtggcatgattgtagctcactgcagcctttagaagagctgagcacttctaaagatctttatttgacccaacataaaataaatagaatgactaaaatgattatgaggccgatcatgcttgtaatcccagcactttgggaggctggggcgggtgaatcacctggggtcaggagttcaagaccagcctggccaacagggcgaaacccagtctctactaaaaatacaaaaattagccaggcatggtggtgggcgcctgtaatccctgcagtgcatagctcactgcagcctcaagctcctggcctcaagtgatcctcccaccttgccctccctacgtgttgagattacaggtgtgagccaccgtaacttgccaagaaaggagttttaaaaggtatgcagtgttcatatattcaaaatacttccctttctaaaatgttttatatacctatgtaaagtgtatgtattatattacacattttataaattaggcaccaggaagttaaataacttgtcaagtcaaacaacgaataaatgctagaacctaggagttaaaaccagaatggtctgccttgagagtggtgtcaagcttactcctgtagaagaaaatggacttgtgtttttaaggccgaaatctgaagggcttttatgtgaaagaaggcttacttttgttttatggggccccaggggtgtagctagataggaaataagtcacagagagaaaaagatttcagctcctttcaaggaagaaggctctggcagtcgacacagttgaaggcgagggccgtgctgtgagcccgtgtctgaggatttgagcagagattctagtgagttatactgtcagggagagtgggggcagcgagatgacatctctttccatcctgagagctgatgctgctataaatgattgttcattcctagagcccactggtgtaaaatataaaggtactagctcatcaaaaaaacttacaacttccttaaagtagcatggaatataaatattattttaatagttttactttttcaatttgtctttggaataccaagatatagatttaaagttgatactgataaaaatattaggttctgttcctttatcaacttactatattagaaaaactcaggccaggtgcaatcgctcacacctcctttgggaggccaaggcaggcagatcacttgagttcagttcaaggccaccctgggcaaccatgtctacaaaaaatgcaaacattatctgggcatggtggcgcatgcctgtggtcccagttactcaggaagctgaggcagcaggattgcttaagcccgggagattgaagctgtagtgagctgtgattgtgccactacactccaacctgggcggcagagcaagaccctgtcccaaagaaagaaaaaaaaaagcaaagcaaaacaaaaaaattcaaatacttttcagtctatagtgttagcatagggagaactgaagacttcagaggaaatgtcactgtcatttaaaaatggttttgtggagtaggaactagattgagggccttcattgccttttgtctgctggcctggctttatcttctctcccacttttagccgaggcaggcaaattgcttgagcacaggagttcaaggcaagcctgggcaacatggtgagaccctatctctacaaaaaatttaaaaaataagccgggcctggtggtgtgcacctgtcatcccagctacttgggaggctaaggtggaagaattgcttgggcccaggaggttgaggctgcatgcagtcatcatgtttatgccactgcactccagcctgggtgacagagtgagaccttctgtctcctcagttttgcccccttgtctcctttttcctgatcacagagtgtcatagtgcttgcgaagcttactgactatttttagtttttcatttgagcctttgagtatccagaagcaacaggctatacagaaagctctaaaataggccggtcgcagtggttcatacccgtaatcccagcaatttgggaggccgaggcaggcagatcacttgaggccaggagtttgagaccagcctggccactatggtgaaaccccttctctactaaaaatacaaaatttagccaggtgtggtggtgcacacctatagtcccagctactcaggaggctgaggcatgagaattgcttgaactgggaggaggcagaggttgcagtgagcggagattgcgtcactgcactccagcctgggcaacagagtgaggctccgtctcaaaaaaaaaaaaaaaaaaaagaaaagaaaaagaaaagaaagaaagaaagctctaagacagggcttaatcacataaactcagcctaaacatacacttagggtacttgcaaggcgaaaatacccaaaataagaaaaggtgctttggaagtcttcactatttggtgttaagaaaaaaagcatcctagtaatcaaattcagaattgtgctgggcctcctctcctgtattttatgttgtagtatttttgtttttaattacatacaggggaaaggataacaaagtatttgatgctgagcacttctaaagatcttcatttgacccaacataaaataaatagaatgattaaaatgattatgaggctgatcatgcttgtaatcccagcactttgggaggctgaggtgggtgaatcacctcaggtcaggagttcgagacttggccaacagggcgaaactcagtctccactaaaaatacaaaaattagccaggcatggtggcgggcgcctgtaatcccagctactcgggaggctgaggcaggagaatcatttgaactcagaaggcagcggttgcagtgagctgaaattgcgccactgcactccagccttggtgacagagtgagagtctgtttcaaaataaataaataaaatgattatgaataccctgaagtgcacatttatttatttcttttaattggcccccagattatagatatgtatgatgtacgacgtgatattttgaaatatgtatgcattgtggaatggccaaatagaactaaataatgtctgtgtgacctcatatacttaccattttctgtagtgagaacactttaaaatccactctcttaaagagattttcaagaataaaatacattgttatgagctatattcaccgtgttgtacaatagatctcttgaacttatttctcctaactggaattttgtatcttttgaccaacatccccgccaaccgctcctccccagtaaccaccctagcccctgataaccaccattttactcactgcttctatgagttcaactttttgagattccatacgtag

SEQ ID NO: 10 - DNA, 26652 bp, Homo Sapiens
gcgggcatgtgcgcgcgagagagattgagtattctcttgtaattttccatcctgcttgtttttaggtgctgccatatgaaatctctgaactgaggattctcatcagccttcccaggacccaaggacatagctctggctataaatggtgccagttttggtgggggagctgctgctgctttatctgggcccaataaaccttatcaaactgctgtgcagccagccttcagcgctaagtggaaatgcttggagcccaatgctggcattcagcccacagcctcgcctgccttcttcctttttgttaccttctccacctcttaaattcaggcattaatctctctttaacacttactaacaagggctgggcttttaatgggcagcgtttatgaagcaagggagattttcacatagagtgaatatggcacgggggtggggaggccagggccatagaggattgtgctttctctcccattgtttccagagattctctctttctctgatttgaggattaataggagattaggatcaggggttaattgtgtgcttctcctgctactgcactgaggagaggctggtaggtggatgtggacagcaaagcggaaacctccagcaggcactatctaggcagaagctcaacaagtgtagtgattctttcttctgtttccctggtgaggcaccaggagggtcttttctcctctccttacatccctccactcttgctctccttgcagcccagttctttcctaactttctttaaatccctttcctctaacagggtgtatagaccttagttagaaaaacaggtagtctctaaatgggattgctctttattgttaatgaaatgaatacccagggactgggcttcccctccgcttgccctgggtttgatgtggttgtatcccgtgctatcagaggagcccttccttcactcaagtgtgttcccctgcccagctctctccgcagactcctgctgggctgagctttccctgctcttaagagtcaggagtggctcttgctgggatggaatgacccgtctttggggctgcctcatgagcggctcttgtgaacccggatcagttccgatgtgtaaactctaccgcctggccttcagcgaacagatacagatttctgccaccttccatgaccctacagttcatgggactgggtctggggcagtgccagaggcacgcatggaggtgtgattctaggtgagtcctgcggaaaacctctggcccacccgtgagtcacggacagaacatgcagactcaggccttggtgacataagctccgcattgctaaaaccgcgtgacctcgagggctgactggcctgagaaccctggatggcgctctcggccacccccacctcccaccccaacctcctgggcttcggtcagaatccacagcccgtgcccgaagagcgcttcccgcctctggcaccctaccttcgctcagctccagggaaaaggggagagggcagctttctgcagtcagaggaagagtacattttctttggctgctctaccctctgaagtagggcggccagctgaaggaggacacacttttgaggggcccagaggttgtccaagcttccccctgccccctgaagactgtgcactgagctgggcgcagttctcgggaactgtttccacccagattgctggggggcgggggggtaggatgagggcagagccgagaggctgtccaaggtttgggagagagaaaagtttctcccaggactcgaccttggcctccagcaatcgcgacagctaaaaacgggtgtctcgcttcgacaatagatccccgcggaccttctggcacctggttcactagcgcccgcgaactctgcctcgggagacttattgaaatccggatgctcaagccgggaggcgcgcagtaaccaggaggatgagagggccgggtttgggctaggaaagcggccttttaaaacagatgtcagggggactgcagccccgagccatgagaaaaaagttaaaggcgagatgacacgcactgaattggggcaaacattggaagaggagacaaaactgcgtgcttgagcaccggggtgcggggagggggggacaaaacccgtatccagtgcaaattaaaatcttgggagtaggtgggggctgctgcgcgcccttcaccctcagttcccctattaaggattctgagtccccatgcactcctgtcctctggctccttccttcctctccgctcggccggtgagaggcggccgccggcgccccagcagcagctagatgtcaggcgaagcccggagcgcggagcgcggggaagggaggggaagggaggggaggggaaaggaggggtggggcggggagcgcgcgcgggctcggccagtgcggggtggtgggcgggctgagcccggggacggcgcgggaggggggagggaaggggggcagctgtgggcagggagccgggctcggccgccagcactaaagatggagaggcgccggggccttgcaggggagggggctcggcgttgacgtgggacgcggcggaggcgcagcagccggtggtgatttgctaacctcgcagcagagaggagttgagggcgatgagagcgggtactgcgaactgccgggcgatgctgtcgctgccgccgtgatacggagagcaacagttccccagcaacacccctccccgacacaggcacacaccccccgacaggcacgcacacccaccccacagtgcccggctcggctgcggtgagtgaggggccgggaagaggcgcaccgcccagcgagcgccgcgcgccggggcttcccggggctggagaggtctggggggcgcgcgctcgcttcggccactcggccgctgggcttgtgccttttttatttggcgtgttcccttcctgccgctgcagccgtcgccgccaccggttgggggtcggctagaagggggagccccggctgtcagcctgggcgcagctgcctccccagcccttcctcttcagggcacggtcggggtgagaggtggggggcgtagcggtgtgcgggggctgagggcgtgagcagaggggtcggggatccggaggctttgtaccgccaggggctggcggagcaacagagcccgtgggtgctcttatgtatgcggaccggtgcgcgggcgcaagataaggttgtggtttatttatttgtgtgtttattcgccggccggctgggaagctagaatcggaggagctgacgagtagatctgggggcggaggggagcaggactgggactgcttacgttttgtttctctttgagaaaacgtggtgggctttttcttgattggacttgatccccaccccccttttgcaggggagggagggaagctccagagggtctgcagcgctgcgggccctcctcggctctcggcgggaccggcggtgacaccggagctcgccgtgcgctcccggccgctctcggtgggtgccggtctctgcacctgatgcgttcgggatgcctttcccaccctggcgcgcccgccgctagctcgcacagcgcctcgcacactcccgcacgcgcttgaaatgcgcacggtcccgccggcccgcggaaccacccggacgcacggagcgctccgcaccgactcgctcgccgcctccccgagacgctcgcaccgtgcttgggccgggcgcgctggccgctggcgccgctggccagaggcctgggacccagccggtcgctcccagggggtcacggccctgggtcggagagggagggcgggcagaccccttctcgcctttcctcccacaactcgctgcggggcttttgtgcttccccttcgccgcggggcgggtccgcctcccctgccgctctcgccgcggagtccagcccgcccggactgtcgccgttcctccccgtctctttcgctttccctcgtccctagctcagctctccttctttcaggagtctagctcctcgggaaaagttgcttccccaagtttgctgaagtcgtctccaagtctcggtgggggtcgctgggaactgggggggtgtgagagcgcggtcgatccccggagctcgggcgggttatcgccggctcttccccgcgccgcctggctggacgctgcagccagcgccagccggatcgcgggcgccgagcggcgggtgggggagacggctgcccgtgggcgcccagatttccctcaggacccaaaaggcttgtttcagggcgccaagcttccattcttttggctgttccctcctagttctcagaaaccccgatgtctgcgggaaagcacgcggtggctcggctcggctgaatgctcatcccaaccttgacggcctccgtccccaccccggggcgggcagcaaaaatgtcttgaccagccgtcctgtgaatcctttctgcgtgagcttggtggctcctgaactgatagagctccttctgggggtggaggcaagcaagcagtgttcgaagagtgagggagagaccttgctgttccttgctctcagtgcattcactgcaatattggtcgctgtaagacagacacggggagggtcctgggcctgcgcggtctttctaacactcctgtaagcgaggtttggagtctaggagccctcttattgatcccgaacaggctctgggagaggcctttgtttcccagccctgtcttcccttcgtactggttgtaactcacaccacaggtgctggtgccaatatcacttccagcgcctctgagccatgtccagcatcccttgctgcccctggtcacaggacttgcagactccttggagcctgtgggacacacgtggagttcacacacccagcccagcatgagcactcctggctgtaggggaccatatttaactatggtctctctccataccttaatgacccatccttcttcgttttttagatcctcctgtccaccgggcagttgtgggcaggagggtaggtacgacaccttacgtaagtgtgtgtgtgtaaacacacacacacttttttttttttttctgagacggagttttgctcctgttgcccaggctggagtgcagtggcacaatctcggctcacggcaacctccgcctcccggtttcaagtgattctcctgcctcagcctcccgagtagctgggattacaggcgggtgccaccgcgcctggctaattttgtattttttgtagagacggggcttctccatgttggtcaggctggtctcgaactcccgacctcaggtgatccgcctgcctgggcctcccaaagtgctgggattagaggcgtgagccaccgcgccctgccccacacactctttctgtctgtctctggctggtgtacatacacacagttcagattttatattatacatacaataactttgaggcttccgtgggtagaaatgacccaagttagtgtgtgggttgtgtgtgttcctgttagtacctagggatggggacaggccttgggtctgccagtgctttgcagccctgagaacagtagaaggccagaggccaaggctgatggtgagaggatagcctttgcggaggagagcccagtgtccatagatttctgtggccatggctacaggctcctggcctccaatgagtttgactctgcttctggggctcctgtagtgaggcagagtttggaaaaactgtttaaagataaggcttgacatccagggggctggcgtgaagctgacaaggaaggggctaaagtcttgctaattttaagtaagtgcacttcatcataatgaatgttggccttgcctagggagcccctactctcagacacagagaaagctgaggacttataggacttcactacaattttcatttcacttcatctaacagatgtcatagagtagtgaattaggcatctgctgtggcagaaccttctttttactctcagcatccctggcttgaaaggcagatttgtagatttctaggaagctacttcaattaaaatctctaagatcctcttgctaagggcttggcaacagggaggagggggcatgttgtagtggttgaattcttacttttagggacactgatgaatttgtcttttgttctctcatctcttttgcttcttcccctcttctttctcctagcctcctctattggcccaggaagcccacccagccccgccacgcagagcccagaaggaaagaaagcctcatgcctgagccgaggggagcaccatggatctgacaaaaatgggcatgatccagctgcagaaccctagccaccccacggggctactgtgcaaggccaaccagatgcggctggccgggactttgtgcgatgtggtcatcatggtggacagccaggagttccacgcccaccggacggtgctggcctgcaccagcaagatgtttgagatcctcttccaccgcaatagtcaacactatactttggacttcctctcgccaaagaccttccagcagattctggagtatgcatatacagccacgctgcaagccaaggcggaggacctggatgacctgctgtatgcggccgagatcctggagatcgagtacctggaggaacagtgcctgaagatgctggagaccatccaggcctcagacgacaatgacacggaggccaccatggccgatggcggggccgaggaagaagaggaccgcaaggctcggtacctcaagaacatcttcatctcgaagcattccagcgaggagagtgggtatgccagtgtggctggacagagcctccctgggcccatggtggaccagagcccttcagtctccacttcatttggtctttcagccatgagtcccaccaaggctgcagtggacagtttgatgaccataggacagtctctcctgcagggaactcttcagccacctgcagggcccgaggagccaactctggctgggggtgggcggcaccctggggtggctgaggtgaagacggagatgatgcaggtggatgaggtgcccagccaggacagccctggggcagccgagtccagcatctcaggagggatgggggacaaggttgaggaaagaggcaaagaggggcctgggaccccgactcgaagcagcgtcatcaccagtgctagggagctacactatgggcgagaggagagtgccgagcaggtgccacccccagctgaggctggccaggcccccactggccgacctgagcacccagcacccccgcctgagaagcatctgggcatctactccgtgttgcccaaccacaaggctgacgctgtattgagcatgccgtcttccgtgacctctggcctccacgtgcagcctgccctggctgtctccatggacttcagcacctatggggggctgctgccccagggcttcatccagagggagctgttcagcaagctgggggagctggctgtgggcatgaagtcagagagccggaccatcggagagcagtgcagcgtgtgtggggtcgagcttcctgataacgaggctgtggagcagcacaggtaggccccgctccagccccgcacctgatgtaggacttgaggccctcacacccctccttcacaccctggctgctcccaagttaggggcctggctcccctgtcttggcaatttgtgaaaaaaccagaacacttcttctaaagttctggcggggaggggagcaggttttttaaagtgtagtgagggggcctaggatctttccaaaaagcaccaggggacactcatgggcgcagcttcttaataggcccttccctttgttttttgcttttgggcccctgtttgttttttcggctgtttggtctgttctcctttgcttggagtgactgataaaatggagagaaggagaaaaggagtgggatgagggtctcttgggccctgcatctgaccatgttactaggtttcaggtcctcgggttcccatgcagtggtccctgtgaagacagcctgtccctttctgcagcttgggagaatgggagggtctgggggctgcttaagccacaagagcagctgcaggttctgaaccttattcctggtgaaagttaatctccttgctctgtctcccttctcattctctgatcctgcacatgcatttagggggaattgatttaaatgcaaggggaaaggatgggtataagagtcttggtcttgcagcctgtgaagtctcattcttatcccatctctgctcacactgaactaaatgccgcttcaggctagcattggcttccctccggcttccgtttccttctctatgaaataaccattcattgagctcttatgacatgtttggttcagtactaagcactttccatgagttgcattttcattacaacagccctttgagataggtaatgtccttcttttttttttggatgtgaagtttcgctctccttgcccaggctggagtgcaatggtgtgatctctgctcaccgcaacctctgcatcccgggttaaggtgattctcctgcctcagcctcccgagtagctcggattacaggcacgcaccaccatacctggctaattttgaatttttagtagagacgggctttcaccgtgttggtcaggatggtctcgaactcccgacctcaggtgatcggcctgcttcggcctcccaaagtgctggattacaggtatgagccaccgtgtccagctggtaatgtccttcttttacatggaacaatactaaggctcagatgtcaagtctcttttctagggtcacatagatagtaagaggcagagctggattcaaatttaggtccttaccccctggtactttgctgcctcttggagtcacttagacttgaagaggatcatgtctatggaacagagcgttttgaagattgcttataggaagtggagtaaataacaggggggataagtagcgagtttgttttttttttccttgcttctgtcataaaccacgtgcccatcattttatcctctagtttctgggtcagatgaatggagtcaagaaatccagctttctgttgtcattgacgacagcatttggctgcataccctgtggtctgctgttttgctgatcttgggtggattctccacttcctcccccttcacccccattcccctgttgctcgttcaggtacgggggatgtgagtgagaggggttggggtggggatatctggaagttgatctcatcacccctagccggaatctgctctgaccctgcctcctcgacagctcagaggcttaacttgtggaaagtgtggcagagctaaacgtagccgactttttccagtgggtgcgaaaaataaccgccactaaggtgtgtcttcttgatgcttgtaccgctcagaaatagactgaggttgtgtttgtttttgctcaaactttcctaaagaggaaacccgctccccaaagttgaccagatagatgtatcatctttccggatgtgaattatttcggctgtgtgctatgagaactgggtatggtgggaagtaattgtttttctggctctcatcaggtcctggttcctggttgcttttctttacccgagagggccacaaaagataccactctcctgagacttccaagttccccttcagcaagaccctcattcctctggggagagagggagagttggccatgttatattcgaaagagcctgggtattggaattggccatatttagtggtgagagcctgtgatacttatttaacctttctgggccttgtttcactcactacatttttttttttttttttttttgagacggagtctcgctctgtcaccgggctggagtgcaatggcgtgatctcagctcactgcagtctccacctcccgggttcaagcgattctcctgcctcagcctcctgagtagctgggactacaggcacctgtcaccccgcccagctaattttttgtatttttagtagagacagggtttcaccatgttggccagaatggtctcgatctcttgaccttgcgatccatccacctcggcctcccaaagtgctgggattacagctgtgagccaccccgcccggccttcactcacttcttaaaatggagacggtcaacagggttggtgctgaattaatgaagtaagatccagaaatcactagagctgtgatgggcacatagtcaccgcagcggtggagaactgaccatctgtcccttgtgttgtttaggcctcatctctgcatggtcctcattggctctgagttctagtgtgtagtgtccacagtgccaccctccatgagggttgtgttgactgtgaggtggtgcagagaatgtccctgtccttgtgagcatatgacagcaagacactggccctggaatcctccgtgtcacatgtgggctgctgacaggaagaatgtgcttttgttgttgttgttgttgttgaggcagagtcttactctgtcgcccaggctgcagtgcagtggcatgatcttggctcactgcaacctctacttcccgggttcaagtgattctcctgcctcagcctcctgagcagctgggactacagatgtgtaccaccatgcccgactaatttttgtatttttagtagagatggggtttcaccatgttggtcaggctggcctggaactcctggccttaagtgatccacctgtctcggcctcccatagtgctgggattataggtgtgtgccaccctgctgggccgagaatgtgcttttgactgagggtggaaagtcagcagctgcagcccaagaagttagagccaggggcagtgcctttgatgggaagcttgggggtctaaagaaatcagaaaggggagaaaataatcctgcgtgtgctcagccctcactcagatcaacagcccctcgggtcccagctagatgtactttgtagaaggctttttttctccccctcaccctcaaaactccaggattaatgtgctattcccttttttctactgttctctgtctccccccaacccatcagcagtctgagaaatgctatggtggaaaaaaaaaaacaacagccctataaccagtacaaacaaaaagccaagacaaaaaaaaaaaaaaaatcagaaggggagattttgaggccaggaagccatggcattcactggaaatatatcagtgataaaataacaggctacagggtttattttattttatttttaagtcaataggcctgagtgttggtaaagactagatacccagcagtccttcttgcatttcttcttggggtgggggggcagaagggaatggagaggaaatgaaggcggattgctggtaagtgaggcaggaaggcagggagtttattatggaatgtcatcggtaagtttccccatgatttgatcccaagctggtgtggagtgaagggtaagctgttggctcaacagatagtgagaatcaaacttagtggagttgtagagcctgtttcctgcagcggacagcaagatgtacaagccgtccactgcaggaatgacgtgctgtaaaagggatgcagtgtcaagtgtagtcatggatgggtgggaagaccagacaaaggcatccaatgggactgacttacctaaacaaaccagaaggaagtcagaacagtgggaagatctgatagataagcagtattctgcaggcagatgaaggagcaagctttgggcccccaaatcttcaccagtgcatccacattacagaggataatgcctgagggaggggaagatcatctcaggattctggaacactgggccctccctttcttattccaaaaggctggagcagttctgcatgtaggcttctctggaaatggtctaggaaccagctcatccaggccaggagcacctgatcattctcagagttacgtacatatgcgataagattgcagggaacagtatagttctatagacttaagtgtgaacatagtcctcatttatagtccctagtctcccatggctcacgcagcttggtctttatgtgtttctgaatttagtgctgcagaggcacaatggggtctggtttctggatcttatacagacaagcacttaggtcagctgcagtggatgtcctgcacagacaccgtcgcaactcttgcctggttcctttttgtttttggagatggagtctcgctctgtctcccaggctggagtgcagtggcgcgatctcagctcactgcaagctctgcctcccaggttcacgctattctcctgcctcagcctcccaagtagttgggactacaggcacccgccaccacgcccggctaattttttgtatttttagtagagacagggtttcaccgtgttagccagtatggtctcgatctcctgaactcgtgatccacctgcctcggcctcccaaagtgctgggattacaggtgtgagccaccacgcccggcctattgcctggttcttgaagggattctcaggaaccacagggaatgtctgagccagctttctggatccgtgtgtacagcccttcccagaggctttgtggagccagctgtacggtgcatgagctttgtggctaagatatcagagttctgcctggcccttggccttggtctctctcagatggtcagctgctctgtttttagtggttgatcatgtagaaggccaacaggtgttgaccttggtttaggctacttttgggatttttgaggtttcctgagactcttggttttctttcatcatcccgtccagaacctctgatgtcaaactaaattctgtttggaaaagggtatgctgtagaataatgatagccacagcaatgatattaataataccttttatcggttgcagcattttcttctttgcaaagcacctctaatgactttatctctcttgccctcacagccttccttgagtgggtacaggtccataatcccatatctgtgataatgaagtctgaaaagctctgaaaactaaaaagtttgcagtaaactcatttagtggcaaaacctgatctgaactgatgtgaggctatatttatcctgcttagtttgaatattcatatgttttgctgcaaaaatattaatgtgtttgattacagagtgctgccctagactctgctggggctgttaaacacgataggtgtcagagtacctttctttttttttttttttttttttttttgagacggagtctcgctctgtcgcccaggtcggactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggcccagagtacctttctaaagtctgaacagttttggtcgttgaagcacctgaaggttttggataagggattatgaacgattatcattctctattgacaaatgaggaaaatgagatttggagcaagtaagtgacttcccatggtcacacagctataaatgggtagaaccaggcactcagcttgccttctaattcacagtcctgggcgctctgcaccaggccatataagaacatgagcattgctcttctgggtcaaatccatctgacctagtctttggttgccatcaccatgcctaagataccaccattggaggctacaaccatcttccttgacgtcaatcctaaaggtcaggtgtagcttctcttagtagctatttatggctgccttgtcattcacagatttgccaaaatcctttttgaatccatttccatttccaggaagtatcctttttaggggtgatgaatgacaagtttataatctcctgggctcctggaaatctggtcttttggagagaggttgttggttgtgaagataggaagatggcagaaggctttgtagtggtgaggccaggtctagacctagctctgcgtttttcagctctgtcaccattgacatcgtttttttcatcgtgagccttaacttcttcatttttaaaactaggcacttcagtgagctctttctggattgttgcgctctttaaaaaattcttttattctttgtgtacccacttatatcttcatgaagtccttttggttaattgaattttgctgttttggaatctggattggcagttcagccagttaagtagggggtcagtttgatttgattctgtgtgttctgactttttttttttttttaaaatactttaacctgcttagggttactgagccatctgggatctagactgaactcttggaacttttgaagatgatttcctttattttattttcaatggaggaaagttgcccactctttcatctcagtgagaagtcccattttaatttgccatcactattggatggagccgctaattgctgggagggagaaagctatagtttagcaacacgttttcctcctgctcgttctaggaaaactattatgaatctttaaaatagtgattatcctaaactgttaaaatcaaattctattcacagctctttgatttcttgctaattcaggagagaaacttttccaatcactttaattttttttattaatttaaagcaagccctgctgaaagcccaagtatatatgacttagagtcttactaaatgaatacaggtgtgcctcagtttgtccattggagggtttctgaattttccataactaaagattttctattctgttttggctgggtgtgtggggtgaaagctcttactctctggcagttatttaagtagtaagaaatttgctacaactcttccccacccccacgttttacagataggaaatgagcactttgactgtccaggtcagacttctgattttgctacttactaactgtgacagtggttgtgttacttaacttctgtgtgcctgtttgctcatttgtgaaacagaaataatagtagtacctacttcattgggttgttataaggattcatcagaaaatatttatcctgtgtgaggaacggtggcacaaagtaagtgctccataagtgtttgctagggtatttttcttgtcattgtgtgaagtaggtcatgctagccatgcagggtgaaaaatgtgttcatgttggtccagatcctgctttctccctgagaccgttcttccgcataggcgtcaatccgtacagtgctgtaaaactgctgcctcgggcacctcatgtttggggctgagacattgcttctgcgtcttccccagaagctgatctcttgtactgtggtggccagggtactctttgtcccattgacctgaggcctggtgagtcattccagttctcgtttaaatttagccgggcagcgctccactgccatcgggtccaaatgccggggaggctcactgatgcggtgtcctgttgcctgtgcacgtggccaggcgtgcacatcactgtgcttatgagagagatgaagagcacagataccaccttactgatgggggtcctggggctgggcttgtgggtgttgggggttccagagctccttccctttcctgcctgtcagtgcaggatgcttctaaaatgtggactcagcagacattgttttgagtgcttgctacatgtcagattctgtgctaagtgcactcacagccagcatctctgtaagacctctagctgtcctgtaaggtgggtatcagtttcacattctcagatgggcggagagaagcccaagaggttagtggacttttctctagtaaagagttgtacaggccgggcgcagtggctcatgcctgtaatcccagcactttgggaggccgaggcgggcggatcacgaggtcaggagatcgagaccatcctggctaacacagtgaaaccccgtctctactaaaaatacaaaaaattagccgggcgtggtggggggcgcctgtagtcccagctactcgggaggctgaggcaggagaatggcgtgaacccgggaggcagagcttgcagtgagccgagatcatgccactcactacactccagcctgggcaaaggagtgagactgtctcaaaaaaaaaaaaaaaaaaaaaagagttgtaccaggatttatgttcaggtcttctggctccatgctctctgcagctgggtgaccagggggctcatggcttcaccagctctggcctcctcagttcctctggtggcttcttgcgaggaggaaggttactgcagagggttcagctctttaggggcccaggccgcatggatccaaggactagtacgtcatctcttaccaacacagagagatcagcttctagtgatagaggccttttatgctgacttgaaaaacagaaaaagagagaaaaaagaaacccatttacaaaaataaaaatcccatgctgttaatttcatgccagcataatcagaaattcccctttctactgtttccccttaaaagccccggtgtccttattatgctggtgcagtctggaaaaactatggttgggttttgcctacgtgaggcttatctctgcagctgcaaggaggggatccggtactttattgtcagcatggaaacttccgctaaatacttagaaaaaccttaattctaaattcctagctcactttcaactgtgtcctcgggacctgattttcttcggtgtgaacagattgtgttcagcattgcagtagaaagggtccaagttaggtaagagaaaggacttcctgagacactggggtgttactgagaaagttgttagaagactgtcacagacattttgatgaaggggggacattctgggccatttgaagtggtttttagagttctttcctctttagggccattcggttcccccagaaataagaagaaaagacatatacacgcacataaaccaccaccaccaggcttgctgagaacaagtcaaatgtgccaccaaaccatcgtcttagtgggagatggggtggcactgcaggggcagaaagactgacgtctgatggacttgggtttgaatactagtgctccatggtgaatttgggcaaatgacttcacctctgtgaagcagcagtatcctcttctgtgaagtgaggttagcccctacctctcaatgtggtttttaaagtatgttaatgagatcacttgtaacctaaagcacacagagtgtgaggccacctccctacttcctgcttctctcatgaccccagcctgacaagggagccgctgagccccctgccaccctcacccggcgttgtgctctaagtggattagctcagcgttgtgatcttaatgccattaggcctgttggcacggctctccttgccatagtgagaagcagatgtggccgaccataatggcccttagcgtgatccatcgggcccacagtgctggggcaaccattattagtgttaatttgggggagctttttatggtagctgggggaaatgtggagggattgttggaaatttatttaagctgttcagcaggttaggtgctgctggggtctactatggcaaaaccctcagctcccccaacccatctctttaaggaacgtccctccccaacaccgaagcccaggcctgattacttccagagttggagagacaacttagcaggctcttgtttcttgccgatgtaccttattagtagcacctggcatcataacccactaatgggaaccagtgctctcctcctgcgtggccagtgacaagtagccctgtcagccggagctcgccgtgcgaggaagttcctattagctttatggtcaggagaacttgtcctgttcaggaaatgaatgttgccgctaaaggtccgcggccctgaccctggcggcataacctgtgcgggccggggagaccctgtgcaggatgcttgggatttcagcccctctctggttcttgtcatatgtaaagagggaatcattgtggtatgttgcagccttgaacttttgatttatgcagtgagggcgacttaaccgtttccatgcctggacggctgtgcagtgacagagccgtgttgtgagcgtatgtgcctaggtacatgtgtgtgtggggtggtcaaggggaaggagagacccccacgtgctagcaggggctgttgctgggagtgggtggatttcatgggaggattccttttcttttttctttttcttgcattcttgcagcatctaaatttcctgcgattgttggctgcaaagtggtaagaagctggagagcattgtgtctggaattgaacctgggttcgaattaatcttctgtctcttagaggctgtgtgaccgtggcaagattcctcaccactcacttcctcatctgtgagatgaagttaataacttctgattcatactggtggtagagcagtgttgttaagtaggtgatgtatagagaatacatggcccagcgtccggccagtggtgtggcctcaggttgtatacttgaaaggatgtgtatacttcagtattttttccattgtaaaattaagggttttttttctttttttcttgagacagagtcctactttgttgcccaggcttgagtgcagtggcgcgatctcagctcactgcaacttccgcctcctgggtccaagtgattctcgtgcctcagcctcccaagtacctgggaccacaggggtgcaccaccacacctggctaatttttgtatatatatatatatatatttagtagagatggggtttcgccatgttggccaggctggtcttgaactcccgacctcaggtgatctgcctgtctcagcctcctaaagtgctgggattataggtgtgagccactgcgcctggcctaagtttttaaaaattaaaaagaatggcatagtgcttttttgctctttaacagatcaagaccaaaagttttccccccatcatagcccaaagtcctaaagaaaggctacttaagttgttcgttttcttttgtttctcccatgagtaatgtttctaagtgtgatttttgcagagaacagcagtgtctgacctcattcttgaggggaacttttctgcctgcctcttcttgagaaaaaatgtttgtgagttgtctggcaaatggatgcgttacttttgctgctgttgctgccgctgccgttttaaaggcccctggtgacaaaggagtgaactgcactttcggggaaagcatgccggaatctggcccagaaaagaggggccgctgggggaagggtttggagatgacgcctcctcaggaactttaaaagaaatctgtccatctgtctctggcatttatggcatcgttgacagcagttcaaggaaaaataaaaataagttcttatctgattgcggggctgattgcaaagccgaaggactagagtggccagcgagtcgggcggctggatctggagttttggagaaagggccactggctcatttctgggcacgcacgctcacggaggcaagttctcacctcctcgtgggcttctcttcactttacgtggaaaaactgtgtacgtctcaaattaaaagcagctcttgccccgcttagagccggtgaaagctgcttcgaaggcgtttgtagagtagggattggaaatgttcaatgcaaaagttaaatcgtgacagttgtcccctaaatgatctgctaaattaaggatccgctaacatttgtgagtctacctccctgcattccccccacccccacccccgcccccttggcagaagggataaagatggtacctaaaaacaatgtgaagcggctgctaaatcgagtgactctaaaaacatttttctttccttgaagttcagtgtggaaaaccagactggacttgtcagggatgcagacctatatagggcccatgtgcctggcccctttcctcactttctagcacaatggttttcattgccacctctcccgcgcctttccccccttcataattatccactattttactttctgtgtcctgacagctacaagagtagtttttgtttttttgagctgagtagctgctaaatattccccagcagccagattcaacggctgggggggagaataggccaaaccttggcatcccctgttgcaaaagtgaaaaatatttctgtttgcagttaattttagtggcaagcagatcatgttaactggatgtaattgcttccagatatggccgagggttttgtgtgttgagatgaagggtctggtaagtgcttacttcctgtgtaaattagcctattccattcagtctttcattctggccagccctggattctgtcattctgctcccattttccccctccccagcctgcagcctggtgtgagaagccgcttgctatgttcctctaagtgtaattcttttgtcacttggagccactctcctcttggttcttgatgtgagtttgcccttaaataatgagaagggtttgaaaagatgccacctggaccccaggccacctcccgcctctttcccagcaaaggcagatctgaagagcatctcctggtcatgggggttgcatcttggaacccagaactccttgttttctatgcatttttttttcctactgccctctgacccccgactctcacctgggagaacaccttctctttctctcaattagtccgactcctcctcagcctgaactaagcacgttccagtgggtccgaaatctcagaaaaaatgaaacggctgttgcgcagaggagaaggttgtggccacagaaaggagttgcctcatcagacgtgaagccgccaccttgccttgcaaagcaggctgcacctcctgacacacctgcccctccctgcaagaaagggaggggaaatcccacccaagagaaccttctccaggttcctgtgggtttccagggttgcaactgaagaaaagtgttaagattcatgttctcctaaattctgcttttgtcctgtggccagtcccacattcttagtgctatttgcataagaggttgctgtttatcttcctatatcagccccactgataacccctgtggtctgtttaacaacctatgaggagtagattacttgataaatgccagtttttccaatatgcaaagataaactgttggggtcagggtgaggggtggtgtgttatgaaggaggggacaggtggggagccaggaccctcttttagtgggctggagaagtgtgaaagagcctgatgaaagaaaacaggtagcttgtcacatacaacagctgcatttatcatacggttgatcagcttcctgccctcacctacttttctcctccttcatgtggacatgcagagtctctgagaacatttcatcaagtgggttgcctatgcccacattaatacaagatgggaaagggtggaggttatctttgctttttaagttcccatctttttctcccttggtcgtctcccacccctacaagttgttggctggtaagcaattgatgctcagaaaaatgatgttcatctgaaatcttaaatgagtggactttttctaccttccctgactttgcaggtgcttcttgaagagccaaggagaaaagaaaacttctgacctcatcacctagtcaataagctgtctgagaaacaaacaaaagagtttagactggctgctaaagctaggaacccagctgatagctttgttttgatgtccttgtaatgtttgcggatcgcagagggtgctatttagagcagggggcatctactgggacagactcactgggaagttgaaacagctagctcaaagtccaagagatgctaaagatagtgaaatacagcccaggaattgagggggagggggttcctcactcaagaaggagactttctaggagggggcgggcgtggtattttctagggacagtatggaatgaagggaagaaggttggctttagaaggaggcaccctgtgggaggctgagacaggtgggtcacctgaggtcaggagtttgagaccagcctggccaacatggtgaaacccagtctctactaaaaatacaaaaattagctgggtggcaggtgcctgtaatcccagctagtcgggggaggctgaggcaggaaaatcgcttgggattacaggtgcctgtaatcccagctagtcgggagaggctgaggcaggaaaattgcttgaaggaggcggaggttgcagtgagcccagatcctgccgttgcactccagcccaagactttgtctcattaaaaaaaaaaaaagaagaagaagaagaaggaggcaccctggatgaagactcaggctccagaatttactatctgtatgtcttgggcaagtggcttagcttctctgagcccctgtttacttttcttttgaaaatgaccaccttgtccatggtaatgaggataaaaaacgtgtaaagtgcatagcagagtgcaggtgtactgggtagacatgtatgattgcgctgtagccctgttatggcccggggagaaactatgaaaggaaccagtgaaatcttttgttttgggcactgctaaattgatgatagtactaaccctgtgctagcagccagctggtgaaataataggtgaataatgttagtacattgtgaatataaaagtttccatttgcaaagtgctactgctgttctaaagaagccacatttctaataaatgattgcttaatcctgtgatgctgccacagccccacagagtttgggaatgtttgggaattctttctgaagtgtgtgccgcattcttttgctttgccttttgggagggtagatgtgactattggaaatggtcaaaataatgcagtagcaaatctgttgactatagtgagtgataagcactgtcggctgctgtgtctgactcggaaggcagattctggaaggggtgtgtggggaaggcttgttggctcagcactggggtgagtgttggcctcacttcttaggtgggaagtggacaaggccaaggggcttttgatttccagctactatggctggactcccagtgaggaaggagtcgctgccatggattgcctgggactgggaagactccttttaactgctgtaatgtttctgcatttgtggtttggcctcctgtgagtttgggctccggggcggcacttctgttgttaaaagaacagaaaagaaaacaaaacaaaacaaaaaaccaggactgtcactgttagatgttggttgaggctagaaagaatggattgagttttgaccccctacaccccggggagtagggaggcctgggaggcacagtggcctgagtttgaattctgactctgcctctttggaaggctctggaaggttaaaggagcttgtgtgttcaaatcttagcctggtacctggcatatactcagcatgtatttttttcccctttcctgacaatgttccttgccccgaacacttgaatagtggagagaggaatgtttgcttttcctctccattgaaccaacactcgcccatccactgagcccaagattcaccttaggattgtctgttggactcggctcttttgtgacctaacagtgcaggggccttgtgctgagctgcacatgctcgctctcgctggtgctccctctctctctctctctctctctgcattatttatagtaaaccatattagaacagagtgttaaagaggaaggatgagtcattcccattgaaaccattgatgacataaataaaagcaaaatgcttactatgtgttttgtgcagtatttaaggccaggttgtgctaatttgaatgctcccaaactggatctgtgaaagcatacatatgtgggaaaaaattcaggtttaactagagggaagttatttattgaaaatccatttcagtatctgctttctcccttctatttacttcagatccatattcatatcatgcttgttgttctggctaacgagagggactggcttattcactagctaaggtttgtttattttcggaaggttgaggaatagcacagagaggttgtctaagtgtccctgtctccattcctcctcttgccacctgttgaggaaggcactctccacctgctttgcaggcgtgggctctcaatgtgtccaagaatcacagtcagagctgaagggcccttggaatcatttattgcagcatgctcatttgggaggagtaagtggaggtccagagaggttctgtgattttccctaggtcacacagcaagctagaggcaaaaccaggaccctcactcccagcccactttaattcttccttcacaagcctgcctgtgactgcccaggtctgttctctgcttctaccaaggggtaggcaagactagaatctgacttgagagcagtttcagatctttgtctgtgagggatgctggggggtttctggcatggtgacttgcctcctgggacactcattaacctctctgctgctgagcctgagcagactaatgtacatcaactccttaggatttacagacaatgccctatgttgggggttttgagacccaaagattgctaagacatgggacttttccttgaagagcttatactttgagttaaaatatgtatgttgatatctatgacagagaataggaaatggaaagactatgatatatatattcagagttgaaatgacttctgtctggagtgattcattttaaattttaaaaccttgttgagcacttactgtctgctgggcacctgggtaggccctgggaatactgtgatgagcaagatagacaagacgtctaccctcctggggctttcctaatggggaagaaagatccttacttagctagcagtcctgtccgtaactgtgtaagggtgattttgatacatgttgggagcctggatgaagtagcacatgagtaggatattaaaggataagtaggttttgaagacggggacagaaagaaggaaaattgtggtcagggccaggggagaaaacaaggagtaactttctttggcaggaatgagggtgattcatgctggaatggtaggctggggtcagactgtggtgctataaatgcgtggagagagattagagaaggcagcatgaagaatggagagaaaatgagtttgaagttgagcagacccgggttcagattttcatgctgccacttgcaaactgtgtgatgttggccatcaaggactgtgaactggctgggtgcagtggctcacacctgtcatcccagtgctttgggaggccaaggcaggaggattgcgtgaggccagaagtttgagactggcttgggcaatatagcgagacgatctttacaaaaaaaaaaaaaaaattaaaaatgcagctgtgcatgcccataatcccagcttctcgggtggctgaagagggaggatggcttgaacttataagttcaaggctgtggtgagctatgatcacgccactgcactccagcctgggcaacaaagtgagaccctatctctatttcaacacaacaacaacaacaacagcaacacacaccatgaactgtagcttcttcattcctacagtgcagttattgtgtgggatagcctgaggatttggggtagtgtacttaacacactctgcacagtgcctgtaacagtgtagttgctcaataaatataactgctgtttgttttaactgctgtttctttttggactttatcccgggagagttggagccttggaaggcatttgaaaaggagagtgacgtgactggagtgctccatactgatgtgacatccactaggcatgtgtctgactgccccctgctccttccctgccttcacgagcctgtctgaaaaggagtttagtgcgtgatcatcagctcctaaggagacctctcccctgtatcttgtacctggcactctaccaagatttgatgagaggacatgaaatggacccttgccacctctcggtgggcggggaagctgggagaggggcctggggagagggggtcttcagctgtcaggatcaaaggaagtgacactctgaagctggtctgccggactgttacccgtctctctaactctcttttaatagaaacccagtctcccctcttgcctccctgatagtgaacagcgacgctatctcccgcgggccagtctcggctgtggtcgtagcactacgcaatgtctgcaaaccgacagtggcatggggagataagggccccaacgttgtgtaacgaggggcatgggctgtttgcccgagtggctcctggcccctgggtaactgctaacctcaacggaggagcgggccggccttggaaacgccgttccagggcccctcgctggttccacggatgcctttttgtggttggataaaggaagctcatgtaggccgcccacagcgcagcatggccttgggctacgggtgtttggttgttttgtttttctcttttctttgtcttttttaaaaaaagaagttgaaagggggatagtcttgcttggcacctaccacctttaacccaaaaccaaataaaacaaacagttcctaaatataaattaaacttcaacctgcagtatagacatcctccttccctgcccgaaacccactggccactggaggctagctttaagaaattggttttggagactctggcttgaaaaggagccatgcccacttgtctcacgtcccagtcgctggctccagggggccgtggtagaacatatattgtacttcagctgcctttcccctccaagcttcctcagccacccacagccctttcagatgagctgagccctagcactgtgccctctcccctctgccctcttagggtgatagaatccactaccctgacatctggggttgccctgttctgctgtggtgggagatgggctggaagggacttcggaggctctcccgtgttctgtaccacccagcttccccttggatccctccacccccgcagccaggagagggaagtaactgttctttgagcaggacatttcattttcaaagtattcttgatgccgcccccccgccccaccgc

SEQ ID NO: 11 - DNA, 2573 bp, Homo Sapiens
acgaaaggacagcagaaatagctccataatctcactttccaggaataacctctatggacattttgttgtgtgtctattgcttttctaatatatacattttttaatcaaatggaattgcctcaaatatgctatttaatagcttgcttcttttcatactatttgaaaattaagaaacgattataatatgcttcatttaaaaactttaagtttaggccgggcacagtggctcacgcatgtaatcccagtacttggagggaccgaggtgggcggatcacaaggtcaggagattgagaccatcctggccagcatggtgaaaccccgtctctactaaaaatacaaaacttagctgggcatgatggcacgtgcctgtagtcccagctacttgggaggctgaggcaggagaatcgcttgaacccgggaggtggaggttgcagtgagcggagattgcaccactgcactcgcctggtgacagagcaagactctatctcaaaaaacaaacaaagaaaacttgaagtatagtatccttttaaattttaaatagataatagaaactggtttccccccatttaaaccagaatttaagtttaactttatatattcttgacagtttggattttgtccttcaacctcataaaattgggaatttaagcatcacctggttcgatttaaatgcaatgtagaatttgcattaaaatactacattaaagcctcagatttgtagtagctaacagcacttctatgtatgtgtcagggactgctctaaatacttcatatatattaactcctctattctgtacttctgttcccgttttatacagcaggaaattgaaacactgagaggttaagtaactaaagttacagagctagagtgacaggagtaaagcttcaactcaggcaacccagacttccagagttctgatctccactactaagctgctagcatagcttttctggtaactatttttaattcaaatataattcgagtgatctatctaacaagtcatcactctgacaactcagtgacttgtaatgtaaaattattcattgtaattcatttaatattattgtttctctgtgctgcaaaaatcatagcaatcgagatgtaatttattactctccctcccacctccggcatcttgtgctaatccttctgccctgcggacctcccccgactctttactatgcgtgtcaactgccatcaacttccttgcttgctggggactggggccgcgagggcatacccccgaggggtacggggctagggctaggcaggctgtgcggttgggcggggccctgtgccccactgcggagtgcgggtcgggaagcggagagagaagcagctgtgtaatccgctggatgcggaccagggcgctccccattcccgtcgggagcccgccgattggctgggtgtgggcgcacgtgaccgacatgtggctgtattggtgcagcccgccagggtgtcactggagacagaatggaggtgctgccggactcggaaatggggtaggtgctggagccaccatggccaggcttgctgcggggggaggggggaaggtggttttccctcgcactgtcttaaaccgatggcctttccttggcacagggtccactgcagcatgccaaacgaggaggcaggggcgtcgtccccccgccccccactgcagcactggagatggatttcctgtacttcggatccagggtttttgacagaagaggaagaagggggaggggtagaagtgttaaggggagtctgctgagaaaagctgtttttgaagccagaaggggtttttgtttttataatgccatttgacagagtggaataacagtatctaaggaaacgggtagaggacaacaaagaatggagcatattcatggcgaggagcaaaagctctaccccattgaaaggcttcttttcctccctggcgacaaggacacatgcattggtggccaaaagagagaggagacaaaaccgctgcagatggctgatgtgaatctagtggaaagagctactggggatgagagaaagaggaggaggcaggtactgcagagcgtgagtggtggtgttggttggtgaaatactggtcaccagtagtgtgcctgcttttgtaaaacatctaagtaaactccctgtgaacagggtggcaaacagataccagtgtctttgttagttacaaaatgcagtggtagtggctttttgcggacgactgcagcagtgctttttctccctctgttaggccgaaaagacaactgcagaggaataagaaaccttgcagcaaatgctggggtagaagcccatttacaagaagccatagtttataaatgcagcctgaacagcagaaaaaaaattactgttttttaaagtaggaataatgtcaggctatgaatgttttgtcattggaatgtattggacactttgattctacatcacgaaagtgatgctcaaattctttgatttaacataaatcctatacgaaatcttaataaattatgtatgaaacagtggatcttttcttttgttagtgaagcttttatgccattaattaggtcattcaagagcaaaccactttacaacg

SEQ ID NO: 12 - DNA, 4160 bp, Homo Sapiens
gcggctgaggggggaggatcacgtgagcccaggagttccaggttacagtgaactatgactatgccgctgcactccagcctgggtgacaaagtgagaacctgtctctaaaaaaagagagactgacaaagtcttttgctcatggagtttatattctagtggagcagaggggctcagaccacaaacaaataactaaatgcacgatgtaattaatgaatgctgctttgggcatgtaacaactacctctcttgtgacctacctggacagaagaaaagaccatttccagcctattctagtaacccacttaaaggaataccaacacattacggaatgttaactgtggatcccgagatgttgcttttgagtttgggggccagaacacacgtgtccagatgtctccctgggcagacagaccggagaaacgggctggcatgcataaacatgccagtagccagggagaacagcatgccccactagctgctggtagccagggcgctgaggattgaagcctgggtactagctgggccttatcaaaggagagcgaaaaattcctgaagatttgaaaaggagagtcttttgcagagaagcaaacatatcacgacttaaaatttgatgcttcaattttgctctcatttctacagtggcagataacacaagccagggaatactcatttgtacatttcagaaacttgatgtactaaggttcccacctgagattgttgtctattttatagaccaattcatatgtctaaaaatccaactagactataaagagcataataacacgcttgccatggttttctctgccgacacattgctcagcatacgtcaatgagagctttgaccaatcaatgtgaatctccttaagcaaaaggcccatcttttcctttagaactaaagctggggctgggcgcagtggctcacgcttgtaatcccagcactttgggaggccgaggcgggaggatcacgaggtcaggagatcgagaacacctattaacacggtgacaccccgtctgtactaaaaatacaaaaagttagccgggcgtggtggcgggcgcctgtagtcccagctgctcaggaggctgaggcaggagaatggcgtgaacccaggaggcggagcttgcagtgagccgagatggcgccactgcacttcagcctgggcgacagagcgagactccgtctcaaaaaaaaaagaacaaaaaaaccccaaaaaacaaaaaaactaaaactgggtattatgaaggaaacttgagaaagaaaagtgaccaattttagttgatgcaagtaatctcacgtatcctcttcttcctgcatagcaagatactacaacccatgactgtcaaacctgagacagctgaagagcccagaaaaaaagattagggaagaaaacagaattgaaaaataattcagaatgacagaggctatctgcagcattaagggcaaaggcgggtaaaagaagaaaagggagacagaataaaagataaaccaaaaaattgaaacaaaatacacgggaattcaaacatttataccagaatataagggaataccctggaatctaaacacctcttcaggcaagaatgtgtgtcaatacaaatgcctggcacattgttttccttccccctttctttttacccagtttacccagttttaaaagtgattttttaaaatgcacctttaaaagaacatcttttgttaagtgacttaaacttgatacatttcttggattactaaggaggttaaagtcacatttggtgaaaaaggggcctatctcctctttcctcacatacgggtcatcgaatacttttaaaagcattttccaccatgaatgaggggaaatggaagaaaagaggtggtgacaattatttgcattttccaaatggacggaatgagcctccggagggtacacgaggtcaccagcgtgagcccgcggtggagctggaggcgtatttatagctggctgacctcagtcctgttgggccctcgccgctccttatcttatgccgctggaattcgcgggctcgcaggtcacaggagcccgggcgcgccgggcctggcgctcccgaatcgatgagggaagccgctctccccggcagatcctcccggccggggagcctccatcaccctgcctgcgcctcggcacgctggcaaggagcccgggaagagacgccgggagcggtgggtgggcgagaaacaaatgcaatgtgacttatatttttctttgtcgcaactaccacgacctggccatcccccaccttggtgacttggtgccttcccagcgaccttatttcacgccagctgactggcgttcaccgcagtgtgagtgtcggccggaggaggggtccacgcgaaagagcccgcgagagtggggatatccggccccgaaggccggagcgggcgtccagggcgccgatggccgcagcgcccggcagccgtgtccacgctcccctccgccgcgttccatcgcgtgctacctacggcgtctgcgggaagctacccgggcggcagctgtggggctggcttgtggggaggggccggcgggcccgcgcggaggagcagccccgactcccgcccgcaccagcagctcggcgcccccttgccggcggctggccctcctccccggcaactgggcgccgggctccgcgaactcttcgggcgcttccgccgtgcgctcggctcttttcgtgtccggggcggggcggggcaggcgcccgtggtcgggtgcgcgcggcgcgggcgggggccttcccagtgcgcgcgcgccgtgcaaggcccgcggacgcccgcccctcccccaggcccccgcacccgcgccgccccctcccctcctggcaagagtcggcggcggtggcggcggccgctgcagagattggaatccgcctgccgggcttggcgaaggagaagggaggaggcaggagcgaggagggaggagggccaagggcgggcaggaaggcttaggctcggcgcgtccgtccgcgcgcggcgaagatcgcacggcccgatcgaggggcgaccgggtcggggccgctgcacgccaagggcgaaggccgattcgggccccacttcgccccggcggctcgccgcgcccacccgctccgcgccgagggctggaggatgcgttccctggggtccgggtgagttgggagtgcgcgtgcggaccggaggggctggccgcagcggggaggccagaggggctcgggcgaggctgcagaggcagctgggcgcgcggtggccggagccaggggctgcccggcccggccccggcagctccgcaggcctcggcgcgcgctgggccgggaccgcccagccagagacccacggcaccccgcgccgcgtcccccgccggcccctcttttgtctcccactcgcgggttgcaggccgagtttggggatgcggagtgggcgaaagtcgctccggggacgcttctggaatccttaaatgggaaaggcgctcacctccccgccccggagcggcgaggctgatatttgtgatttggctccggacgctgtggggaggaacaggggagaacaaaatgagtttcgggcgggggtcgagtgagaggagcagccggcccgcccccgagtccccgcgggaaggggccctggcccccgagctcccggagctgcttcacctgttgtcctgcgcggcctccgctccgtggcctggtgattccgtacttcagttttggaaaactttctgctggattgcctggacccttttttctctttccagactcctagtggaaagatttggcaaggaaaaaaaaatgagcttgcgtcagggaagaaaaataatatgctgtgtgttagggtctggcgtttgagcgtggtactctttcatgctctcagatgttttaatttggtcaaactcctgcaggttttctcttttaagcggttaacaaactgttcagagtacatagtatgaacttggcacctgtgttacgtcatttaatccttacaacgattctggtttattgtattcctcattgttttaggggaagaaaccgagtcgcaaagaggttaactaacttgtctaagggagctgggatttgaacccaggaacatcgtattctggcaaacgaattaggaagaaaaaaaaccaaaactgtttgcaaacacttttacgtttaggaacatttttcagttactcttacttgaaattatcg

SEQ ID NO: 13 - DNA, 7824 bp, Homo Sapiens
tcgtggttacagggttaattaaaatatatgtatctatatacattttgggtattcatttcatctattgaattttattaatttatatatgtaccataaaaagaatttgtttcctaaatccacagagtctagtcccactctggacataatgtgctttcaaaaatattgagagaatgaatggaaacacttcattccatatgagtaaataaatgcactctacagacctaactttccaaacacttataaattcatgttttctttcataaaaatggatctaaattattgcttttaccattctcaagactgagaaaggtatgtttcaaaagagagtaatacttagttgataataagactgtcaaacgtgaaactaaagataaattaaggagctaagtttcaaagaatcagtataagttgccttttcagtaaagaaactaaagaattaacttgaagtagaaagaaattttctgaatttgcaatgcttttctagcttcaaatctccatcctttggtctttggtcccacgattgtttacacacctcaaacaccacaaatgtcaagtgtaaacacaatttcacataaagttttactgcacagaaaacagagtatggttaacttaagggggttacttacctcatttgatttactattcattttgggggctggttttaatatgtgtagtgtatgcctgaatgccctgtgctaattccattgataatttttgttgggattagggaacattgtgaacaagtaagtagaaaatgagggctgggtgtggtggctcatacctgtaatcccagcactttgggatgccgaggtgagtggatcacctgaggtcaggagttcgagaccagcctaaccaacatggtgaaaccccatctctactaaaaatacaaaattagccaggcatggtggtgcatacctgtaatcccagctactcaggaggctaaggcaggagaattgcttgaacccaggaggcagaagttgcagtgagctgagatcatgccatttcactccagcctgggcaacaagagtgaaccactgtctcaaaaaaaaaaaaaaaaaaaaaaaaaaatgagatttgttactacttgtaagacctgtggctagcctggtactatatttttcatatgctagaaaacatgctctaataaatatctgtgaatgaatagttattttacctgccatgtccttcaccccaacagagaatcatcagattaaattttccatttccttgatccacaagatttcgggtatacctaaaaaaaaacaatatattcagaagttttaagttcgttgctgaaacaagcactggaaaaaataagtgtgtcaccaagtaccatttattcacaaatgttaacatttccacctctaagcaactttgaatgcagttttctaattagaaatccaacacaaatgaaaaatcctttttcacagttcattttgaaccgctgcatttacagaggtagctgctcagttttaattaatggcacgggaaaaataacaggaaaaaaaccgaaattgcatgtttctcaatgtgacagcctcaaactgatggagtaagtttctcagagaaagtatttccaaagtgcattactggttgaggcaagaatgttgctattgtttttttttttttcttttttctgcctgtagctaaatcaagacttgagaaacaaggtttcattaaatagctgttctagaattcttagttttactaaagcctagacacaaaccacattcaaaagcccttataatgaaaagtcttccacaaataccgtgggggctgatctaactaccagaacaaagaagactacattagtgaagtaaagaaccctctaaacctcttacaattaggagaaaccagtaactggcaaacacatacacacagacacactcaccacaaccaaccaccaccactgccaccaccaacaacaaactgcaaaccacgaccacgactgtgaaaaaagcaaaatcaacgtcaaagtttctattggtccaaggtgtactgttgacagcatctagttagcaaagtttcataattatgacattcatttagactgtcatgttaaagaaaaggggtctttactccattttttgggagttttttttcccttcgtcatcggttaactcttgtccagcatgccccttccatcctgtcccattcctccccaccccgaggtgtccgaagagcatgatcctagagggagttacttagtaagtgctttttagcctcagttttccctactttgtagcctttatgacctaacaagaagctgtgtacacaaccttcaattcacagtaaactgagttcctgcagaaggatcctaattcttcctccagaagtcttaggataatctttgttgcttctctgcagcttctttcaaagaattcacagcctggcccacacgggagcatattctgtcttgattcttctgcactggccctcccaaagtcagagaacagaatccttcacagcgctaggcacctatttaatgcaaaaaatactgtagaattgacttctctcccatctcctgtcttcccccaactgccccctcgggactacatccattatgttaatgagctgtacctcagatatctgtgaaaagaccgatcaacccagctggttgcacttcaaaagctttagagtttgtcaatcgagactagttcaaggtccttgaaaatacacttgttctaaagattaaagattaaaaactgttacaacctgtcctggtttaacagtggtttagagtgtaggctctggaacaacaatgctaaccccgggagcctggagccgctatcgatagaagacctagtgcaagtcattcaacttcttcattgcctgccattcctcatatgtgtcaagtgtctggaagagtacctgtcccataacaagtcttcaattacctggagcaaatgcaagaaaatttaaaagctagactctctgctagctttcacggctacagaagggctctaccatgaactaagctgataggagccaaaggaatttcctcaagtcacttgtatatgaaaaatgggatccttagtggtcttcactttttctatttcaaatcctaaaatacagttgaaaccgcccatgccaacaaaactttacgaaacatcccacatgttgaagagtgactaaaagaacctgctcccaagaaaaacaaacttacttctttccttattcttttctttcacttacccctttctcctaaccctaaacccaaaaaaccacaaagactgacgcactaactgctcagaaaaagtagaacctctcacacttcggggtgattaaattttacctctggccccggaggattggtagagagattcgacttaatcaccaagccggggctgcaaaaaagccagcttaccagggcacctcactcaagtacatctgggaagtaggggtctttaatttacattacagatcgtcagaagcaaggataagataaatcagatcatttgggggctgaaaaaaacgacggtcgaatatttaatctgcgaaacttggcagtggatttgaataaacccacagtcggggaagttagttaaattggtttgggaaagggaacagcagaaattccgtagtggcagctgacggccacaagacgctattttacatgagtaaaaatgcttgctataaggtgcccggttgcaggcgaccgaaggcgcagtgatggagaactgacgcgggtgacttgtcttcttcaacatcacacacttctcccgatggctgatgtagtgctcccctgggagcaccctctgctagtccggccagacggttccttaaggtgtcaggagggcccgaacctgagtgcggtctctccgcatctccgcgcccggggttaacgatggcttgggagtgtgggcattgctcccgaggccaggggcaggaggactggtggtttagaagcagaggggtttgcgggagagaagagaacagaaaatctcgcagacgcgcggtggcctcccttcccggcgcctgtccgccgttcccggccggaggtcagcaaggccagtaggatccaccttccgcctgcgctgtggccgcggagccccaagcgagtcgtgccagccccgcggctggccagcgagggggcgagcggcggacgcagcgcggcccgagcttcccgagccagtcactttgggctgcgtcccccacgtccattcctcctcagacggggcgagtgggcgccgcctggcattgaagctgcagcgcgctcacctgtactggtcgaacttggcgtacattgcccactcggtggggtcgctctcgtaggcttccatgatggcctgcacctcctctacattgacctcatcgccggcaaagagctggtgcaggatgcggatcagatcagccagggtccgtggcttcagcacttcggtctgttccatctcgtggggagctggctgcgcgcgcgtctcactgctgggctgcggtggaggagctgagcgagccaaggagctgggggcgagggagcctaacagcccgctagaccgctaagcagacacacacgcacaaacccagcattagagtgccgaaacgtaaggatgtcgtcgcagagacagcaagagacccacccccaggcccctggcagcgcagtggatccgggatcgctggagacgcggtgcacacacaaatcaggttcagatctgtggggttcatcctcccgggccccttttaagcgcttggagtcactaggaatgtaccaacggccctcggagggaggacgaggcggagagccacccaagaaaggtggcggaggcggggagaccctgcgggcacggctcacgcgcacatccccggcttccccgggctccgcgccttcccaagagccccgttgtctccggcgtcccagggatcgcgtgggctccgcgcaatctctcccccactttaacggcgcgttttagccgcccggcctaacgcctctccccgctccacctccgccgctgtggttcgcgacgctgggacgtagacaaaaagggtcggaggagatggctgcggggactgacgctgagtaaaggaggaaaagaaaagggaaggagagggacacttcttccaaatagagaattgtgaggagcctgcgaaaattgaggatggattccactcctaggccagagagtgcctgttttgtcgattgaaactatccacgatatgccccaggctaggtgaaaataagtccaagactttatatatatatatatttaagtatacacacacacatattttttaaaatgcgtactgaaatatattttgacaaaggagactcgggtctctagtaagacaattagtgaaatgatggaaaaccaagaactctttgattttaaaatcaaatattttcttttaaaaaatatccagtgcaaataacctgatatttcatttgatggtgtaaaagggggctttttctgaggggatagggcgggctctgacgcaataatttaagaggctataattatatttgaatctttcaaccttaggcatgtgcttgaaggagcctgctagtacatacatataaggaaacacgtttctacgtcatgcatagcacctagtacgttgggaacaacacaaatcaagtacagtaggatttaaatgagaaagatgtgaaaggtggaagaaatgcaagtgtagatttcttccttctcattatggatggacgcagggaataatttggatttaaggttattaaagttctagacttctgaagacctgtttttttctagactatgatcaccctccctcgtgtatatacatgtatacaatgaaatttacttgtgccaggtagtcttaaacatctctggtaaaactcgctacattatattctaacagtgttgttaaaagcggaatcacctattgttcaaaaatggctacaagtagaaagcattccagaagccagccttggtgatgtgtgttgctgcggggtagtgaattaacaaagtattttgtgacagagtaacctgtaaacttttcatggtttcctcaaattattttttattcttggcaatgttttctattgagtctcttaattacttcatttcagctagtctaatccataaatgtttggaatgaacaacaaaaatgaaatgcaagcacaatttatcttttctgcatttcagttgataaaacttctaaatttttctgacaattcattttctttctctgactcctctttttctttttacatttttatgaaagtaatatattcacgtagttaaaaaaaatcaatagtactggaaggtcaatgaaaagcagcaggcccttttaaccattcctgaccatctgtcctgtgcttaaagagtcagtctcttaactcttctaactattccttgtggtagttacttcctttttccaaaaataggcttatatttttttttgtttcagcaattttagatattatctagtcattttacattatgatagctccattcgtttattattcattcattaatttattcaacaaatgttttttcgggtgaatagaaattttcatttcacctgagtaaatacctaggagtgagattgctgggccatttagtcagtgcatgtttaaatttgcaagaaattgacatactaatttgcaaagggtctgtgccatttcacattctcaacagtgatgtatgagttctagttgccccgcatcctcgccaggtattgtcagttttaccaattttggccaaatagaggtgtgctgatattgcattgtgttcttcattttctatatctctaattcttatgggcaggtctttgttcttagagctcccaagatggtggccaccgctcccaggatggcagcaagccttttgttctctgaactggggttcttggcctcatggattccaaggaatggaaccttggaccatgcggtgagtgttatagctctattagaagccgtgggtcacagaagagaaccgtggaacccagctactagtgttcagctcaaataggacgaacccgggcacttagccatgcaggaacaatggcaagcctttagccggatcgggagtggcaatgggtgcctcgctggatcagcaaagcagcggacaccctgccggatctggaggggtggaagtcggtggcgggtctgtgacagtggcaaacagcagtggtgaaaagcgagcgaaagctcagctcgagccataacaaacacagaccagaagagtgtgcagttgctagatttaatagagtgaaaacacagctcccatacaatgcgacggcacgcaaagagggttgccactccctgctttaatgcctgggtttatatccggatcattgtccctcccccatgctctcaggcgatatattatttgactatttctttacctcctgctttagcctaatttgtattttagtgagccctctttactgcctgattggttgggtgtgagctgagttacaagccccgtgtttaaaagtagttgcagtcacctttcccagctagggcttaggaattcttagtcggcctaggaaatccagcttgtcctgtctctcataatgactaatgatgttgagcatatttttatgtgattagttatttgtaaataatttttggtgaaatatccaagtattttgtccttttaaaaacttaattatctgttcttattgttgagttttaagagtttattatatattctagaaacaagtcagatgtgtgatttgtatatatttcctcccagtctgtgactggtcttttgtttgtttttttggacaaaggtcttgctgtgtcactgaggctggagtgcagtggagccattggctcactgcagctttcaacacctgagctcaggcaagcctactgcctacgcctactgagtggcagggactacaggcgtg

SEQ ID NO: 14 - DNA, 2665 bp, Homo Sapiens
ttccgaaaatgttcagacacatttaagaatttttattgagtaatacaatgttctaattgaggcatacacgttgttctaggagtctgtgaaattctaaagataaaagtttgattatgcttgttttgactttaatgaactattcacataattttaatacacagtgtctaacacgtatgaaagttgtgtaataccttataccttaacaatggagaattactaagcaattttggctactctgatattagcatttcctgaaactcctcaggctgatgtggcaaaggagaaatagcaatcttgagttctgaaaagctaggccgcattttggtcctgaaaaatcacttgctgtgaacttgggccagtttttgattttttaaatggcataacagttcgttgctacaagaggttacatcaggaaaatttcctaaggatttaagattttgttcatctattgagttcttttgggtgatttgtttaggaggaagtatctgctcctttttgagttgcttcaccaaagtacttgagtgagaaggcagaatataatgagaatgatcatgctggcaaggaagacatatatatgagatgggttatcctttacacctacgtcagctaaaaccgtctcctacgaacaaatccagcacttggcactttattcgacggtcctaaaaatagagtcctaaatttagaaggcaaggtgctacttttagctcctcttctcggaggaaaacagcacgcaccgcgccaggccaaggtccacggggatttgatttagcatttgggtaactggccgctaatggaactgaagacagctgggcctaacaagtgcccaggtgactcaggtaagcgaggaaaccagatcgaggttctcttgcgtgggacaggttaaactctgaccaaaccacagctgagccgggacgccttcctgtctaaagtccaaagtccggacgtggttggcagggcgcaccggcgcgtgccccgcaggccatttttctgactggaatgacggcggcggctggcttctcggggctgccggggtctcccggggtacgccgccgtcaggacttctgcagggcgcagacagcaggctccagcgaggctgcggaaggaaagccttgggtgtcggggctgggcctggcgtcggcccctgggtcgggggggtgggggttgcgccgagacgcctctaggagaagtctcgccgccgccgccaccgcggccgcccgaggcgggtgcccttgggacatagccctggtctttggggttgtgcggctcacacgacagcgcggagtatgaggccgaatctcatcctctagtcccaagcctctccactaccagggctgggtggcttcgccaggtagagcgccggcccctttaagagcaaacgacccggacacgtctgcgaagcttgcgcgaagaaggggaagtttgcggctgtccgcgcctccccgccttctcgcggctgcccggccgaaaccaaaccgaggggtggggtggcgaggacagggtacgtcgcaggcttgtgcgggtcgggctcggacctgcgctgcctcgggatgtaaagtataacaagagggtcgggatgggcagcgtaggcctgtgaggcctgcgggtgcccctgtcccccagctccccccgcagccggctccgcagtggtccactccggttgccgggtgcggattcgggttccggaccgaaggctgtgtgttctccgccgtttattgtggccccgacaggccggggttactgtggcgaccacgagagcagctttggcgctatggaggagcccggggttacccctcaaccgtatttggggctgctcctggaggagctacgcagggtgagcccaggcgcgatgagtgttacgtggcccaggggtcgcgggagccgccgggggaaggaagcagtagaccggctttggggtctaagccgccgtggtcagaggtcccgaagccagtcctcgtctgctgcccggctcccgcccgtgttcgaggcagtagttaggctcgtagggcgcttgagtggtttttgtgtgatggaggaggacctggggctctgggaaggtgaagaaagcacttgcttagctggactttgcaaagatgtaaatgtttcccgattcctaaaactaattagcctttccgctatgttgtttattttgagcagagacacgtggttccttcgactgtgagaaacttgaggactgttcctttaaattagttacatttactgatgtaacttctcgttgaaccttgaaagaacacctgaggttgggcggggagttgaaattttgattctgcattttttttttttttggtaaagaatgaatgcccttttgagatgctctaccatgagtgagattgttcttcgcttctgtcttgttaatgtacagtctagagatagtaaactcccagtgttcaaattttgttttttatttttcaggtctagtttataatcaagttgtagagatttttctccttaagtgtttctaggtatctttgttgacatgtgtaggggcatttatgtcgccgtgtttttaaaaactggattaaatctttaaaaagaccacttaattattgaggcagttacgattatgttttcttgttaggtgaattaaaggtagtgttgccatggtgtttatgagttcatagtttgtctaatgcatacgcatatatat

SEQ ID NO: 15 - DNA, 8788 bp, Homo Sapiens
gccggggcctgcagcctgggtaactgaggagctaaacgctcctgagtgttgtgcctccaggtttccctggatttcttttgggcccttccaagctgaggcagggggtgggttgggggtggagcaggagaataggaggccggtagtgaggcacaagccccctcccggcaacagtgagcttgaagatatgcagccaagggcaagtgctgcagccgcccccgctgggatgggtggggctgtgactctccagcgcccagaggagagaagctcctctggccccccaaccaagcagtggtgatgaggccagaaatcagagcctattcagagctcaacacacaggctctctctcctctccccctccaccccctgggattatccatttccttcaaaagcaattcttgcttctactcccaggacctaaggcccgcctgtcaagcagcgaatttcaacaggtctttttaaagtgacagagcccccaggtgtgcttaccaaaagaacatggtctcgtgtgtacctcatgtgctccttcctccagctttttgtcagtaagactaactttcccaaccgttctggatgtaaatccgtgtaccggcaagagtcctgactggctctgatggtaccccggatttgggaccgggtgagcttggctccaggagttttcagaaagccctccagtctaatgcagagacaggagcccagctggcccctccaagcaggcttgggaagggggcccaccctgagtttaagcccgggaaacccaagggcccagctgcctgacggaagtcagccaatgggggaggggcaggacccctggccaagctctctctgtagtgcagcttgaggactaagtgtggggatagggggcacataggcactgtgaggtgaggggaaaacaaaacaaaacaaaacattctggcgatgtgtgtaaggagcagatctgcctggagcccaggctcctgccctggttacttggctgccaatggggcaactctgagggccatgtcacccttcccaggccaggaggagtctgggatgaaccccacgtctctgtgcttcccccaggtcagttgcacccataactcaaagaccgaggttcctcattccaatcctctctccagccctccggggagggggcagcaccatttcccagagcggcgcactgtgacacctccgcgctcatcccaccaatcagtcaataactgcccaaaccagagaccttacaggaacagaagaatatccagcaataaaaactagaaacatgccccatgacttgcgggggggggggggggtcagtgtgcagacacagcctcagggacttttcatcaacgacgaacattcccaattgccttcagtctgtgtccttaacacttaggcagtccgccacgaccccaggctgcccagcttctccagcccgactcagctgcgctggtcctgctcacaccagcgcacagtccaagccagctaggacgccggggccacgtctgcaccaacccagccaagggctcgaggcgcgctgggcctgcacagcccgcggctgcaagagcactcagagtgtccttcaactctttgcaggaaacttcacagccaaggaagctcagcggcctgagccacagggttttgttttgtgtgttcagaggcaacagtttattttggtttgcatcggtgtcctgtgacagcgcagcgagtttctcttcagcgaaagaaaagaaaaaagccctctcccagtgaaacgggacaccacggttcccagtggcccagggccttggagattgaactttgctgcagctctcattctggggcaaagcgcttggccagctggtgacaaaagagcctgtctgcaggtgtgtttggggagctggggagggggcgtgtgaggctcggagggtccctgggcctctctcaggtgaacccgagaagagacaggaagacagcggctggacgcgcgcccaggtccgcgtcgctgcggaccgcggagctgtgcagaagcgcggcctggcgggtggcacaagcccgacagctgcgccgcgcagcccgcccgcgcctggccaagagccccgcgagggtgtggggagaggatcggcttcgcagggagcggaggctgcgcggctgcatcggacctcacagcctcaagtcgcggcatgaggcgaactttgcaaagcgcgctctcgccatgcaccgcccgacctccagcactgtgcgcagcaggacctcggagcccattcgcctgtggaaaccgagcccgcagcgggaaggcagtgggtggagggtgggcaggcaggggtctggggtccgcggctccccaccctcgcgccttcccgcgccagtcccgaacgctctcttggggcgttcctgcccagttgtcccggctgacctcgctctgcagccagcttgaggtcaggcggtcgctctctgcaggtcacaaaccctcggcgcaaaagtagggctttgaacgcgacaccgcaccagagcgcccagctaagcgagctgcctccacccccactgtgtcgggcggcgcaaactgcgggcgcaggcagaggagccgcggctctgcgccgggcgggagccgaagcccagagcctcgccagggcctccccgccgagcgcacttaccgtcgctgaggcagagcgcggtcagcacgaggaccagcacgaccacgaccttggcgttcatggcgcgggcgggcgggcgggcgggcggacgagcgcgggtcgggggccggacgccgagcgggcaatgcggctgacggagagtgaaagtgcggcggtgggaggcgcgcgccgggcgctttagaggggagagccaggcggggcggggcggggcgcgcggtgaggggcgggcccggagccgagtgctggccgtggccggggtctctgacgcgcgactccctcggcggcaccccccacccatccccttcgcccctcctccgctccctctgtgctcccgaggcgcagtgcgctccggcctttgaccttctcaggctccgctgggccccgcaccgctggcccggtctgcagtgaggtccgcagcctgagcgacgccggctggagggccgcttattgtccctgtgacagggccccactggagagactgaggaccttaggcgtaaagtggggcgcgcgtggaaagctgcgggacggggcctttcgatggcgggaactgaatgagaaccaatgaaaagcaaacaagttagtcccgggcggagggcctgctggcggtggcggcccaaggcagccgagggggtcctgctttctgtgcgtgggggctcaagctcgccacctgcccggcttgcggcgcagccgccggcagagctcgatctgcgggaatgagacccgtctttgcagtcagcgtggctcggactccaagcccacggcgccaccagccgagcctcagtttcctcgcctgtacaaacaaagcagaaggcgccggcggctctcagtaaaagcgaatgtagcctttgtacttccgacctctcaatggtgaaatgagctaatcacaggcccaccccgcggagtgggacgggagattcaatgagacccgccccacgccgcgaaattctctgcatcgtgtctgacaagcagacagtactcaataaatggtagctgtaagtaagtcctttaaacctaagtacttactgccttacccaagaaaagctccgtgcgacccaaagagctgagaactcccccaccccgacctccgactcctaggacagtactactggcgtctgccttctgggtccagaaaactcttcccacggagccgtccctcggcggtgcttagccctccggatacccccgagacatcccagatggccccagtccggtggcgaagggagggtgcaggtcggcacccaggagacgtgggggtgaggagagcgcccctttgggcctcgctttgtgaccgcaggctgccccagccacctctctgtgtccttcccagcacagcgtccagcgaagtggggtcagtcgccgcgtccatccaggggcctgccctggggacacgtccctgtccctggggagtcctggccgtcggggagtgggcggtcagcggctgcattaggcgggagcggtcaacaggaggctgcgagggctccggaactccgctggtgggagtaggtgtcttctgtgcattttttttccaaaaccactttggccgttagatggctgtgggccggcactccatccatccatccatccatccatccacccacccacccacccacccacccaccctgggcactgggcttggagccgggaaccccactgacttggccctgctcttaaagaactgaaggcagtgaggtccagtgaagaaggcagccgtcgggcgtccccaggcctttgctgggctgggccggggagcctggccgctcaccggccgcagcgctggggctccggcgccctctggtggcggcgcctccctccccgctcccagagctctggccagctccattcctgcgcagctgatgaaacccgggagggcgaaggggtccgcgggaaatctacacccgggtggaggggcgccctggagctcggagatccgaccctgcgggagccgcgcgcagcctcgcttgcccttaaatctggccaaagcaaacgccatcgcctctcgcttcttcttcttctttttttctttgccacaaaatcaggtgggcagctggacctaggatctgtcccagaagcctgaaaggcccgcgtgggctgagtcgagggcgaaccagggattcaggcctggccgctgcccctcccgcaggcgccctgaggccccagaacagaagctactgtggcacccatggggccatcccttccgctagtcgttcgttaaatacttactgagcacccactatgtgctagacctgggctacatgtttgaagtagtttagaaaaggcactaaacgtttagaagcacatggcgctaagcataagtaattacgcataaaatacttagaaggccattaaatgctaggggaagatggagcagaggaaagtggggtgggagttaggattttaaatagggtggccaaggatccatattttaggtacaagcctcacaattttacaattggcgattgaaatttaaaaccctggccgggcacggtggctcatgcctgtaatcccagcactttggaaggccgaggcgggcggatcacgaggtcaggagttcgagaccatcctggctaacacggtgaaaccccgtctctactaaaaatacaaaaaaattagccggccgtggtggcgggcgcctgtagtcccagctactcgggaggctgaggcaggaaaatggcgtgaacccgggaggcggagcttgcagtgagccgagatggcgccactgcactccagcctgggtgacaaagcgagactccgtctcaaaaataaataaataaacaaatatgtaaataaataaataaatatgtaaatatgtaaataaaataaaataaaaccctgtacactctgggggcctccgcaccgcctgcacaggcaggcggccatcagaccaggccattttgacatgtctccagctcactcggccacaggggtacctctcaaattcgggtcagcgaagttccccacccctttccctgtgtcctttgcttatgcttatgctcaaaaggctccacctttctttctctgcctggggactcttactccccatagagccccaccttctcctgaagtcttcagactctgtgccgctctaccaggtaatgcagggcacagcggctcctcagggatgccttgttaagcacagttcaaggtgggaggcaggggtctggctgctgagttaaaggcagggcatctcctgagctggcatgtgtgctatggtctctagacccctaggcagcatctgcctacccccctctgcctggcctgggccgttcactcctccagggcccaacggctgggcctgcaagagggttcccagtagggattgaaggtttacactaaatccatgttgtacagtgtgtaattgacaaggtgacttcaggtggtactctgaaatctataaaatatagatttatgtatttatttttttaaagtaataagaaaaaatataactagcacagtaaaggcagatatttcagatattgctcaggttttttttttaatatatggttcaagttttaaaaagtaagtcaattgaagctaacatagcaagtgctagtctaggtggctggagacatagcaaaaattttgacagcaatacaaatagatctgaaatttgaaaaccttttctacatgaagaatattttttgtattacttgacaccctcccaccgcaatccccctcttgaaataagtatttggctccaaagtgctgaaacataaaatcacacaagggaggcacgatgtcttcctcacttgcctgccaggtgaggctggagaacgctggtccaggagcgctcaggtcataggaagactgtggggccctatgggatccctggatacccttggccctgccacccctccaggagtgctcctctcccagctcccgtgcagtcctggagggacccctcccaaccacccacatctgccctcactcctttggcacctggccctggggttcaggagcagatggcctattccaggaaccaggaagcccggtgaggaagacaaatcctcaccgccttgctgatgtcatctgtgcagcaggtacattagctgacatggtggatttggtcagtgtgaaaccacttggcccagagaaggcccttaggaagatactgaacagtggacttacataggactttagtttgccttctttgaatttgtcaatttggtactttcaaagaccgagcttgcagtataagccccactgtctcagctttgaagacatggaacccaagtctccatgggctctgagcccaaggctcagagttgagggcctcggccaacatgacagagccaggcaggagcaagggtacatctctctggggccaacgtctctggatcctggaacatcagccaggtcctgaaagcactcttggggacataagtcactcccatggcagtcatccagggagccttttggaatcccgtacccagggccaggacttggcatttgaccagctggccatgtttttcctgtctagatccccactggcctcaagagccagttgcaaacagccccaggctgccctagagggaaggacccctgggaggcagagctgatccccactggttctgggcacatgtgtgggcaagcaaggcttaccgtcagggtatgtgcacgtctagcaggccaggacttctgtctgagcaggctctgcccaaagacttccttgctggacagtgctgaggcagggggatctgagaatgtaagaataacaaactcagtttctccttactctcacaacacaaaatacttttgtgacttcagatgtgtgtgtgtgtgtgggggggggggcggggattccccacatacaaagccagtagtccttcagctgcagacaccagctggctgtcttctaattcaattcaactctgagatgatctacctggaggtaggctcaggccccacatgttgaggccccagtcccacaaggctgcccctacttcagataccagttgcaagccctgggttgttttcccagtgcttctgaccaaatgaccataaattagggtttctatgaccccatccttgggtttcattaatttgctaccacagctcatggaactcagggaagcacttatgtttactggtttattaaaaagggtattatgggctgggcgtggtggctcacggctgtaatcccagcactttgggaggctgatgtgggtggatcacctgaggtcaggagttcaagaccagcctggccaacatggtgaaaccccatctctactaaatatacaaaaatcaactgggcttggtggcgggcacctgtaatcctagctacttgggaggctgaggcaggagaatctcttgaacccgggaggcggaggttgcagtgagccaagatcacaccactgcacttcagtctaggtgacaagagcaaaactctgtctcaaaaaaaaaaaaaaaaggatattatgaaggctacaggggaagagatgcatagggcgaggtatgggggaaggggacatgaagcctccatgccctctccaggcaccatcctccaggaacctccactgtcgtgaagccctctgaaccctgctttgttgtgtttgtatagaagctcattacataggcatgattgattacattactggtcattggtaacttagccttcagccctgtttccttcctcagaggctgatggggtggggctataagttcccgccttctaatcctgcttggtctttctgatgactagcctccatcctgaagctacccaagggttgccagccatcagtcaagtaaaccaaagattttaggagctgcatgccaggaagctgggacaaagaccaaatatatatttcacaatagcacagttggtatttcctgggacattccccgggactgtcggactaccagggctcatagggcaaatcagacccaaggccccaggggttcagatctgtgctcccagtccccacaccagttcccaggaaccaagtagtgaacccttcctgtgctcagtcaccacagtcaggcctggattccttctgcctccctttcctagccccacccctctctcctattccccttgcctctgggcagactggactcagcagctggggatccactgaaggttctcatactggagtatacatcagttcctacctatcagaaaccccagagtgtgcacactgagagtgtgaacagcattgacactggagtcaccctgtgctgcgtgc

SEQ ID NO: 16 - DNA, 13114 bp, Homo Sapiens
cgggaaaggggtcagggcacagaagtaagggattggggtgcagagacaagaggtcggggtgtggaaataagggatcggggtgcagagataagacgtcagggcacagaaataagggatcgggggattcttgccccctagaaaagcggtacttgccactaagggtgaaggagaaggggttggggggttcttgcccccccagaaaagcagagaaggggtagagacacagagaaggagttgggggttcttgcccccccagaaaagcagtacttgccactaagggtgaaggaccaaggcaggcatccccatgtggtcagacacctctgaaacgtgggtgaataatcagagaggtgtccctgcgtgattaaacaccaagggaaggctgccttcccgagtccatgaccggcgctggagttttgggtccacgaataaagcgcgtctcctgtctctaccagaaaaggaaaggaactgaaattaagagaagggagagattgaagagtggaaaggagaaagtggttgagggatagtgagagaggttggagaagagagtaaaaagaggctgcttactggatttaaaattggtgagatgttccttgggctggttggtctgaggacgagaggtcgtaggtggatctttctcatggagcaaagagcaggaggacaggggattgatctcctaaggaagatcccctgattcgagttatggcaccaaatttcactcacgtccgtgtgaagagaccaccaaacaggatttgtgtgagcaacaaggctgtttatttcacctgggtgcaggcgggctgagtccagaaagagagtcagcaaagggagataggagtgcggccgttttataggatttgggtaggtaaaggaaaattacagtcaaaagggggttgttctctggcgggcaggagtggggttcacaaggtgctcagtaggggagcttttgagccgggatgagccaggagaaggaatttcataagataatgtcatcacttaaggcaagaacaggccattttcatttctttcgtggtggaatgtcatcagttaaggcaggaaccggccatctggatgtgtacatacaggccacagggggatatgatggcttagcttgggctcagaggcctgacagtctggatcacctgacctggtgatccgcacacctcggcctcccaaagtgctgggattacaggcatgacccactgcacctggccttagaaaacttcttaaatattaaaatgtatgttatgtgtattttgccacaatttttgaaaagtaccttctggtgtttagagacagaagatgagtggttgcctagggccgggagagtgaggggatcgtggtgatgggcagctggtcggcatggggttctgaagggcagtgatgacaacattctaaaattagactgtgttgacggttgcaccaactccgtgaataccacaaaatttaaaccattgaattatgcacttttaatgggtaattgtatggcatgtaaattatatctcaataaagttatatttttaaataccaaaaaaaggccgggtgcggtggctcacgcctgtaatcccagcactttgggaggccgagaagggcggatcacgaggtcaggagatggagaccatcctggctaacatggtgaaaccccatctctactttgaaaaaaaaaaaaaaaaaaaaaagattacccggacgtggtggtgggcacctgtagtcctagctactcaggaggctgaggcaggagaatggcataaactcgggaggcagagcttgcagtgagtcgagattgcgccactcaggaggctgaggcaagagaatggcataaaccccggaggcagagcttgcagcgagccgagattgcgccactgcactccagcatgggtgacagagcaagagtccatctcaaaaaaaaaaaaaaaaagattagtaatatcctctgtgtcacttaccacttaagtgattgaatcacgacttgaaattcatcatctcaaacatggcttagagtctgtagaggggggacagtcccaggaatgctggtgtgggcttaaggctgaattaaatagatccagatggctcacacctgtaatcccaataccttgggaggccgaggcaggtgggaggctgaggcaggcggatcactggagctcctggagcgaagaaaggatgctagtggaaaaactggtgaaatcagaataaagtctatagttttattttttaaaggaggctgggcgtggtggctcatgcctctaatcccagcactttgggaggctgaggcaggtggatcagttgagttcaggagttcgaaaccagcctggccaacttgacgaaaccccatctctactagaaatacaaaaattagctgggcgtggttgtgggtgcctctaatcccagctactcaggaagctgaggcaggagaattgcttgaacccaggaggcggaggttgcagtgagctgagatcacaccattgcactccagcctgggctacagagcaagattccatctccaaataagagagacatgacaattaaataaattgtgtaatcttggattaaatcctaaaccaaatatatgtcactggtaaaacaagtggtgaaatttgaataaagtggatagatcagacaatagtgtcatatcagtgctatttcttgaccttgaacattaataacagaatgtccttggttttgggaaatataacctgaagtgattagaggtttagggcatcatatgcaaattagacacactttcttcggggagagagggagagggagagaggctgaatgatgaagcaaatgtggtaaaatgctaactttggggaaatctggatgaagaaattacagattttttttttttttatagacagggtaacactctgtcacccaggctagagtgcagtggcacgatcatggctcactgcagcttctacctccctgggctcagatgaccctctcacctcagcctcccaagtagctgggactataggcgcacagcaccacacctggctaatttttgcatttttttttcccccaggctcgtctcaagcaatccacccacctcggcctcccaaagtgctgggattacaggtgtgagccactgcacctggccagaaattctttaaactatttttgcaagtctggaattatgtcaaaattaaaagctcaaaataataaaagacaatattcttatatttctttggtgaaggtaactatgttatggctgagagggtggctgaggtctgaggatccagcctacataagtctcctccatagagggcatccaagcgctccgtagggggaaggataaagaaaacacccagagttatgacagctgtgtaaggggaaacgccagcaccgagtactgaatcttcagtaaataagaaggaggcgggctgggtgtggtggctcacgcctgtaatcccagcactttgggaggctaaagtgggctgatcacttgaggtcaagagttcgagactagcctggccaacatggggaaaccctgtctctactaaaaatacaaaaattagtcgagtgtggtggcacacgcctgtaatcccagctacttgggaggctagaacaggagaattgcttgaacccaggaggtgaaggttgcagtgagctgagattgcaccactgcaccccagcttgagggacagagtgagattccgtcttaaagagaaaaaaaaaagaattagcacatttgtttgcctcaagaagatacaactagtcttgtacagtagtcacatgtatccaccaggatatattccaaggccccagtggatgctgaaaactacatagtaccttacatgtatatatatatgtatatacatatatacacatatacgtatatgtatacatacatgtatatatgcatgtatgtatatacatatatgcatatatacatacatgtatatatacatgtatgtatatacatatatgtatatgtatgtatacacgcatacatgtatgtatacacgcatatatgtatgtatatacatatatgtatgtatacacgcatacatgtatgtatatacatatatgtatgtatacacgcatacatgtgtgtatacatatatatgcatgtatgcatgtgtgtatatatacatatatgtgtatatatacgcatatacatgtatgtgtatatatgcatgtgtatatatacatgtacggtactatgcagtatatatacacatatatgtatatatgtatacatatatgtataaatgtatatatgtgtatatatataaaaggtatatatgtatatatgtgtgtatatataaaatgcatgaatttcttttttcttactgtagatcttaacaacttctgcatagaatttttttttattaagtggagagttagttacttacttaaaagaaatgtttcttggctgggtgtggtggctcacacctgtaatcccagcactttgagaggccgaggcaggaagattcacttgaggtgaggagttggagaccatcctggccaacgtggtaaaaaccggtctctactaaaagtacaaaaatgagctgggcgtggtgttgggtgtctgtagtcccagctactcaggtggctgaggcaggagaattgcttgaacccacaaggcagaggttgcagtgagctgagatcacaccactgcaccacagcctgggcaacagagcaagactctgtctcaaaaaaaaaaaaaaaagaaagaaaaagaaaaagaaaagaaatgtttcttttcttattaagttctttaaatgaaaagcttttcttttcacttttattttattgaaacattataacactatctttgaagaagttagtgttatcattccattctgatgaaaccaattaacttatccaagcatatgtatactgtacacagagaagccaacgtcaaaacccctatttttatctttttagattcagcagatacatgtgcaggttttttatgagtatattgcatgatgctgaggcttgcattaatgatctagtcaccaaataggtagattttcaagccttgctcccctccttacccaatgtttagcgctctcacttataagtgagaacatgtggtatttggttttcttttcttttttttttttttttttgagatggagtttcactcttgttgcccaggctggagtacaatggcaccatctcggctcactgcaaccttcaccttccaggttcaagcaattctcctgcctcagcctcccgagtagttgggactacaggcatgtgccaccacacccggctaattttgaatttttagtagagacagggtttctgcatgttggtcaggctggtctcgaactcccgacctaaggtgatccacctgcctcagcctcccaaagtgctgggatgacaggcgtgagccaccgtgtctggccagtatttggttttctgtttctgtgttaactcgcttaggataatggcctctagctgcatccatgttgctgcaaaggacataatcttgtgatttttcaaggctgtatagcgttctgtggtgtatacatatcacattgtctttatccagtccacctctgatgggacctgggtggattccatgtcttcactattgtgaatcctgctgcaatgaacatacaagtgcatgtgtctttttggtagaatgatttattttcctttggctatatacccagcgatgggattgctgggctgaatggtaactctgtttgtagttctctgaaatatctccaaaccaaactgctttccacagtggctgaactaatttacacccaccaacagtgtataagtgtcccctttgctccacaatctcaccagcatctgttaatttctggcttttcagtaatggccattctgactggtgtgagatggtattgttgagggataatttaggaatcagagagaccgaggggttgaggaggatttattattattattattatttaggtgcaccggccccagtcagattaacatccaaaaagactgaggctcgaacagagagtccggttaccttttaagcattttgtggggttgggggagatctgtgcagggggaagcatattacagaagcaagaaacaaaggcagttattcaattgagacatgcatcacattattccttacttttcaagaaaaatatgttttacgacttgaggttatcctgtctagtgatcttgcagccgcacggcaagagaaacagggtcttcacaatgcctgggaaagggagagataaggctcactagccacagacagaaaaacaggcagttcatgtttaaaggactccacctctttctcttcctcggggggaactgggttttcttaaatacaactgagtttttgtttacacattctgtaatttcttttaattcctgttccagtatctcactgtgaaactccctatgtttttatacgattctcagggggtttcctctgggcatgattgggcacaacttcccacagtcagctctgggtacgacctccacattgcagaattgagaagttgacccagaaatgcattttgggctgagcagacaattgtcagagttgctggctagaccacagatgtgtcagagggaccacggcctttctgtaagctcatggtcagaggcggaggggagttgtgaacgttctgatgaaagcagtcaacgtgaaagcgctctggtgatgggcgctggtgctcacccaccacttcctgtgtatctatctccctggcccgcccggctcagtccccactgctcagcactaggccggcagaatctgagcgatgtcttccacactccctgccctgctctgcgtcggtgagttctggcgtggaaggggaatgggatcacggtgtgcctgggaggcaacaggtctcattactcccgtcttccagggctgtgtctgagtcagaggatcagcgcccagcagcgtgagtccttccttcaaagcccagggtcactcttccgggttcaggccaagctccttccacccaagcacggctggggagaggggacagggtgctggcttcccaggagagcttggggccagcagctgggtggagcctaaggttggggggagggggctccgctggaactccagcctctgattcccttccagagactctcccaaaaccgttcatctgggccgagccccatttcatggttccaaaggaaaagcaagtgaccatctgttgccagggaaattatggggctgttgaataccagctgcactttgaaggaagcctttttgccgtggacagaccaaaaccccctgagcggattaacaaagtcaaattctacatcccggacatgaactcccgcatggcagggcaatacagctgcatctatcgggttggggagctctggtcagagcccagcaacttgctggatctggtggtaacaggtaactgtccggttctctaactggagagtgatctcagtctgcatccgggatgcagcatcatctatgaactcttccaagccccactcagacactgcttgtctcggtaggaggctggaaggaggggtgatccccatcacaatccttgcctacaaggggttgtctgcagaccgtgtctctacgtcctaggagcagatgtgtcctcagtcagtttctccatgacacagattctgagatagatatttgtatgcaggggtatgactgaggaatgtcctcaaaaacaatgcctgtgggctaggcgcagtggcttacactttgcttccctcacccatcacaggtggtgggttttttttttttttatctgttttgagacggagtttcgctcttgtcacccaggctggagtgcagtggtgcaatctccagtcactgcaacctccacctcctgggttcaagtgattctccagcctcagcttcccaagtagctgggatcacaggcacccaccactacgccacattttgtatttttagtagagatggggtttcaccatgttggccagggtggtgtcgaactcctgacctcagatgatccgcccgcctcaccctcccaaagtgctgggattacaggtgtgagccatcacacccagccaggtggtggttttctaaaaaaaaaaaaaaaaattagctttttttttttttaacaatatggttgtttattattattatcaagtattatacatagttacatatacatacataattgtatgtgctatacaattaggtttgtttataccagcaacaccaaaaacacatgagcaatactttgtgctaggaaggctatgatgtcatcaggcaataggaatttttcagtttcattataatcttatgggaccaccatcatatatgtggtacattgttggccaaaatgtcattatgcagctcacaacagtatttcatgtccattcaaatatcttcttttgtgaaatgtctatttaaatcttttgcctatttttaaattgggttgcttatattttgattgattaggaaaagttatttctatattctgtgtcatatacttgtgttgaaatatatatattttttgtctgtgccttttcatttgctcagggtctttggaccttgtttggaggttctggcaggggaacacagctactcatttattcttttttttttaatttttttagtatttattgatcattcttgggtgtttctcggagagggggatttggcagggtcataggacaatagtggagagaaggtcagcagataaacatgtgaacaaaggtctctggctttcctaggcagaggtccctgcggccttccgcagtgtttgtgtccctgggtacttgagattagggagtggtgatgactcttaaggagcatgctgccttcaagcatctgtttaacaaagcacatcttgcaccgcccttaatccatttaaccctgagtggacatagcacatgtttcagagagcacggggttgggggtaaggtcatagattaacagcatcccaaggcagaagaatttgtcttagtacagaacaaaatggagtctcctatgtctacttctttctacacagacacagtaacaatctgatctctctttcttttccccacatttcccctttttctattcgacaaaaccgccatcgtcatcatggcccattctcaatgagctgttgggtacacctcccagacggggtggcggccgggcagaggggctcctcacttcccagacggggcggccgggcagaggcgcccccccacctcccagacggggcagtggccgggcgggggctgccccccaacctcccggacggggcggctggccggggctttttttttttttttttgagacagtctcgctgcagtgcagtggtacaatctcagctcactgcaacctctgcctcagcctcaattctcctgcctcagcctcccaagtagttgagattacaggcatgtgccaccacacccggctaatttttgcatttttagtagagacggggtttcaccatgttgaccaggctggtctcaaactcctgacccaggaggtcgagtcttcagtaagcaaagatagtgccacggcgctccagcctgggaaacagagcaagaccctgtatcatttttaaaaatggttttagacggtaaatcttctattgtgtgtatttgaccaaaataataattaaaaaaaaaaaaaaagctggctgccaggcatggtggcaggcccctgtagtcccagctacttgggagggtgaggcaggagaaacgcttgaacccgggaggcagaggttgcagtgagccaagatcgtgtcactgcactccagcctgggcgacagagagagactccatctctaaagaaagaaaaaaaaaaatagctggctgctcatcactgagtttctggtgtggtggccccaccttctctcatagaaatgtatgacacacccaccctctcggttcatcctggacccgaagtgatctcgggagagaaggtgaccttctactgccgtctagacactgcaacaagcatgttcttactgctcaaggagggaagatccagccacgtacagcgcggatacgggaaggtccaggcggagttccccctgggccctgtgaccacagcccaccgagggacataccgatgttttggctcctataacaaccatgcctggtctttccccagtgagccagtgaagctcctggtcacaggtgaggaaatgctcaattccccacacccttcgccgccatgtcctacctggagccctgagggatccccagagagtgatggggagggtgtccaagggacgtccacttcctgggtgcctggttggtcatgtgaggaagaacaccagaagcaggaaggaggagggagcagagaaaggaatggtaaggcgggtggatcacaaggtcaggagttcgagaccagcctggccaagacggtgaaaccccgtctctactaaaaatacagaaattagccagacgcagtggcggacacctgtagtcccagctactcaggaggctgaggcaggagaatcgcttgaacccgggaggcgggggttgtagtgaaccgagatcataccaccgcactgcaacctgggcgacagagcaagactccatctcaaaaaaaaaaaaaaaaaaaaaaagaatggcaagaccggaggaaaccaaaaacccttacttttttttctttatctccttttccaggcgacattgagaacaccagccttgcacctgaagaccccacctttcctggtgagtaactggtccttctaagctcagacgagcgatcagagcctcccagtgacactaaaaacgtggcattcattcaaaatattcatcgaggccaggcgtggtggctcacgcctgtaatcccagcactttgggaggccgagatggtgcatcatttgaggtcaggagtttgagaccagcctggccaacatggcgaaaccctgtctctactaaaaatacaaaacttaggctgggcatcatggctcacacctgtaatcccaacacttcgggaggccaaggtggttggatcacaaggtcaggaattcgagaccagcctgaccaacatggtgaaaccccatctctactaaaaatacaaaaattagccgggcctggtggtgctcgcctgtaatcccagctactcaggaggctgaggcaggagaattgttgaacctgggatgcagaggttgcagtgagctgagatcgcgccactgcattccactccactgcacgacacagcgagactccatctcacagaaaaacaaaaacaaaactattatatatatatattcatcaagtgcatagtatacacagtgaactacactgtaacagtcagccaggcagatatcttgactctgcagcacttagattctagcaggaggagacacaccatcggtcaacgtcaggatagcacacaggagggaatgatgctatggaaggaaaagacaaagtagaacagacttacagtgattgaaatggcagctagcaatattaaataggtttgtccagatggacctcacagagaaagaaggcatctgagcaaatgcgttcagacttgagttaatcatgtggctgtcaggagaaaggaggctctggagagaatgaaatggcatctgcctgtgccctggggcaggaagataactggggtaatacaataataactatgaggccaggagggttgaaaatgatgtttggaagatgacggtgggatgggcctggggcgcacggctaggattacaggagtgaggcccggcgcggtggctcacgcctgtaatcccagcactttgggaaaccgaggcaggtgggtcatgaggtcaggagatcaagaccatcctggctaacacggtgaaaccctgtctctactaaaaaaaaatacaaaaattatccgggcgtggtggcgggcgcctgtagtcccagctacacaagaggctgaggcaggagaatggcgtgaacccgggagacggagcttgcagtgagctgagatcgcgccactgcactccagcctgagcgacagagtgagactccgtctcaaaaaaaaaaaaaaagaaaaagaaaaagaaaaaaaaatagtgagactttgaatttcactatgtgtgtatgtgtgaggagaaagaggtaatgatgacttaatgaggaaaatgaggcttaaatagaagacgggctgggccgggtggctcccgcatgtaatcccagcactttggaaggcaggggcggctggatcacttgaggtcaggagttcaagaccagcctggccaacacagtgaaaccccatctctactaaaaatacaaacatgagttgggtgtggtggcgcacgccagtaattacagctactcggggctgaagcaagaggattgcttgaactcgggaggcggaggttgcagtgagctgagatcacaccactgtactccagcctcagaggcctgtcatcccagccctttgggaggccgaagcaggcaggtcatctgaggttgggagttcaagaccagcctggccaacatggcaaaaccccgtttctactaaaaatatgaaaaaaattacctgggtatgtggtgtgtgcctgtagtcccagctactccagaggctggaacacagtgagactctatctcaaaaaaaaaaaaaatagaagacatgactggtgcaaagacacatgctcacaagtgctagaatggaattcctcgtcaggttcgtccatctgtggacccttccactttacctgctggatgaagctcctgggacccgcagggtgaggtgggaccttgtaaagctgcagaacgtcatggggtagacccaagggaaggagtgctggggtggaggaggtcaaaaccatcctcttttcttcacttcccttatcatcagcagacacttggggcacctaccttttaaccacagagacgggactccagaaaggtaagtagacagctggggccataggctctgaaggaaggggctgggcatagagtagacctaggaagggaatctaaatgggaacaagagggtgtccttggccaggcgcagtagctcacacctgtaatctcagccctttgggaggccgaggcgggcagatcatctgaggtcgggagttcaagaccagtctggccaacatggcgaaatcccatctctactaaaaatacaaaaaaattagccaggcgtggtggcgtgtgcctgtagtcccagctacttgggaggctgagacaggagaatagcttgaacccaggaagtggaggttgcagtgagccgagatcgtgccattgcactccagcctgggcg

SEQ ID NO: 17 - DNA, 5619 bp, Homo Sapiens
aacgtctgctacatgctaaactccataaaatgagcatccgacctccccaaaattccctaatttaccttcaccaattctatcaacaatgtctgccccattagcagtacctttccttccttggtttttgccaagctcgtgcccagagttaaggatagaactttacatgcgtcaccaatatgttgccatctgggacaaaacctaataaaaagattaaggctagtgttcacccctgaggagtcccaccatacagaagcaaagagaggtgactgctattaacatctgggtgacccagagccagatgcacatctggggcagttcacattagcctcttaaagcttaccatgtcccttctctttttttgtctggtttgttggtttgagacagggtttcgcactgtcccatgggctggagtgcagtggcacgatcacggctcagggcagcctcgaactcctggggttaagagattctcctacctaagcctccgagtagctgggaagctgggtctacaggcatgcgcaactaggctaggctaattgttttatttttttatttttattagagatgaggtcttgctatgttgccccagctggtcttgaagccctggactcaagcaatcttcccacctcgacttcccaaattgttgggattgcaggcatgagccaccactcccggccacagcatcccttctctttctgggtgctaactcttctgtgctgcctacttctcagcaaagagtaagtgctttccagattctggagtattactctgtactccttaagtgtgggcttcatgtagtaatgccttccaaagagtttgaagaaactgagaaaagctacctctactgggtaatcaaggttagcattaatgataaatgacatggatagtatactttttgttgttgttttttgagacagagtctcactcttgtcacccaggctggagtgcaatggtgccacctgcctcactgcaacttctgcctactgggttcaagcaattctcctgcgtcatcctcctgagtttctggaattacagtgccttccaccatgcctggctaatttgtgtatttttagtagagttggggtttcaccatgttggccaggctggtcttgacctcctgacctcaggtgatccgcccgcctcagcctcccaaagtgttgggattacaggcgtgagccaccacgcctggctggatagtacatactcttgatacgatgtgatgagaagggagctttatctttgtgggcttcctcccgaaaacctagagccctagtctaatgaagggacagtctacaatacaaccaacactcctcaaaacagtgaaggtcacataaaacattcccaatctgaataaggcataaacctcagttaataatgtgtcaatattggtttgttggttacaataaatgcaccatactaatgtaaaacattaataacacggggaaacagggtattgggtatatgggaactctctgtgctatctttgcaacttttctgtaaatctgaaactgttccaaaaactgaagttttttttttgtttttttttttttgagaaaacagattccagggctttcattgtggtcatttagatacccatctggtggccaccaagcagcacttgccaagaaaaaccataaaaagtacctcccttcagatttggcttggaaactatttccccggaaatccccccaccccacccgacaaggaaaataaaagctgattaccaatctgggaggggtgtgagtattcgttccctgaaaaacatgactttaatcttaatgaacagaaagaccacggatattagtgcggatcgtttgcagattcttaattgtatcttttcaaagcaaaagatgtcctccagattgcaactctagaagactggtctcttctgttggctaattgtttccatctccagccaagacacaaaattattactaatgaccatctctgggtatccaagggaagaggatacccaaagctaaagcaaacccctcacctaacgtggccagagaggacaccgatggaagcgaaaacttcattatctgcctaacacagtgtttgtgggaaacatcaggccaccaagcctccttgacaggcttcctccacgagccagtcagcacaagcccttcctacacactagatggaggcaagcccagagtgcgtctggaagctactaacaggcctgccactgagccttcaacaagcattggctgggctgggctgggctgtcaaaatcaggaagcctggttgggttttttgttttttccaagacaacctgctaaccagaaatacacagtgaggttgggcgtgtggccgcttccccctcctcctcctcctccctctaacgaatgctcctgttaaacacgtgaagtgacagataagcattgggcccagcccggggaagtccccagcccccagcaactgagggcagttggaggcacagagtgacaaagttcaggcagaaagagcctgtgtccttctgaatccatgctgcagctgcccctcaccctaccccatcccaccacatccattaggactaagcgtagaagatcacttaatatagctcagaccaatcctcttgtgagtggtaagtgatgggttcagcagcagaacccagggaggaaatgggccggccttataataccaaaggttttaaccctctccagcatcagacagacaacctcttcctcagtttcaacacaaagtccccgtcaaccactgctcacaggaggtgatgggagctgcgtggcctcacttcagtgcctggagggaaggagcggcctcctacccttgataactgggttcagctgcaccccccttccttctttttttggcaactcctccctgctaactccattcttcgcttcctcacctcctccctccaaaggcacagaaatcatgtcccttgccctttgacagcccagtcccaggcaagaggccagcagacagcacccgccccccagccttgggacctgcctgccaccttttgttttgctgagagtgaccctcagggagcagtcatgagcaaccagaaactggtgcccctaaggggcaagagggagccgaccgccccctaagggtggcaggggccactgacgcctcccctccctggcacctgggtaggggcaccctccctccaggccccttaggaagggggacggctggagccaagaggactcctgtgcccagtccccaggcctgagcccctggcgggctcaggggccaggccaggggtagcctccaccgaccttcgttcggattcaaatactcatagtcgaagaggatggagaagtcaagctcgtcttgggggctgcccccaggctcgtggcctggggcgtccccgccgtcgggttggggctgccgctcgggggcgttcatggcgcgcagggcgggaaggctgcggggccgggggcgagggcgggcgcggctggctctgggacccctcgcagtggggctggcggaggcggctcgagcggcggggtccctttcctcgtagggacgcacgccgggtccggggacggcgcgcctggcgcagcgggtcctggacgcgcccggggaagctgagcggcggcggcgacggcggcgcgagcttcctgctccggaggcacctgttgcagcccggggaggcggggggggggggggcgtggaggcggggacagggcggccaggccggcgggggcggggccgccaccaggggaccggaggggaggggcgcgcggcctgggctggccggtgccgggaggaaggaggctgtccgcggacctgaccacactgtcccgggccaccgctgggcgctggggcggccgctgtctcccaccctccacgggtgagtgcgacacgcgctgcgcgaaccagggtctagacaagaaagctgccgccactaggacttttgccctaagggacccactggccccacactttttcctgcttttcttctccatggggtggaagggggtatccacccccttctattgcagacccgtgtctccaggcgtctccgtgtgcccacgggggcggcatgattttcacagtacttcagacacctgcatggccctgaactcaactccccagcgcctaggaaggaatcggactgacagcactagtcccccccgttacagctatgcctcctggccacctaccacgtgccaggtgctgggcacccagccggagccagacactgttgccctcggaagctcaggctctggtagtgggagaggcctgaaggagagaaacaggacaaaaagcatctgcttatggggccaggagagaactcaccagggtatgggataaaggttggggtggctttagtcccttgggtggtcaaggaggacctctctgaggaggtgacatttgaagaaacctgattgatgaggcgatcttggggaagtgtgttctggcagtgagaaccaaaacacagagccagagctcgaaggggctgggtgtgctggagggagaacgaggagtacagttctgatggggcggttggcaagtgacaaacacgcctggctgcttgtttaaagcatgattcccaggcccctccctggagcttctgattccataagtctgaatacagactcgtgaatgtgtatttttaattaagcacccaacgtgagcattaatgaacaggtacatttggcaaacactgcataaggacccagtaactaaagaacaccctccaataaaactctgccagggggctccaccaacttagctgaagttggaaacagactcacagaggtagaaaagatcaaaacagtggtcttcaacccttcccacatattagaatcacctgggacacctttttaaactcccgtgctgggctgcaatccaaacccactgaagcagaattcctaatttttttttttttttttttttttttttttggagacggagtctcgctctgtcgcccaggctggagtgcagtggcgcgatcttggctcattgcaagctctgccttctgggttcacgccattctcctgcctcagcctcccgagtagctgggactacaggcgccagccaccatgcctggctacttttttgtatttttagtagagatggggtttcactgtgttagccaggaaggtcttgatctcctgacctcgtgatccacccgcctcggcctccccaagtgctgggattacaggtgtgagccaccacgcccggcctgaaaatttttttaaacttcagatgaatctaaggtgcagccagtgttgaggatgagaagattagacgggagaggtcttaagatcctcgtgagaaccacagcttgacctcaagtgattcgaatccttccccatgtgccaggaggaattgaggacacgcattcttcaggggagccatctcagctccattaaggggatttgtgccaagccatccatcattccacaaatatttattgagcacctgcctggcactgccacaagatgttggggatgcaaccatcaacaagccacagcctctcccttcatcatgcttatgccctgaaagcaaagtagcacagttatgaacggggttttcaaaattgcactcagaccagtggttcttaacccagactacacattagaatcacctggagagctgttaaaatttgtattcaacgacctgagcaccaccagacatcga

SEQ ID NO: 18 - DNA, 11143 bp, Homo Sapiens
cgtaagaactgcagtaaacagaactgtaggaattggaacaatacacgaaggattagtattgtctaaaaacccttctttatttttctaaattttctgctcaagagatttctttgtcctttttgtctactatgcccttccttgctaattagtctgatttttattaaatgtcctgccagtaatatgatttttattaaatgcactaccaaaatggattacgcaatgacattatgaacttaaacatctttaagatttaaaaatgtgtaggtagcttcactgaataaacaacactttacaaattattttttacctctgtgcaaaggacagtgcatctgttgaagaaaaccagcaacacttgcttgattcccgcccccaccaaaaaaaatgggctaattcatattaatttaaaaacattttattgatgaaaaatgtgaatcatatgcaagcagccttttccccccctctctcgttagaaaaaaacacaacagtttgtacctgctggcaaaattggtttactctgcaaagatggtactgtgttttacccctcctggcttattaaagagttaaacacttttgaaattatatttatttcatttttacatttctcttccttagcctctgtgtgtccattgaaaacattgttgggtcctttaacaattttcctagaactgccttccaatcgtgtccatggagaggtggttatactctgttctcccagtggctcagacacgcagcttgtctagaaagccacagccgctgtggaggaggtaagaggtcagctctttcgttggtcctggtgagggtaaaatttttaggcaggaggagcactgactggcaaagggaagaggaaagggttcgccctggaccccacaaatccgcctcttggagcaaacagcctgcaggtagaggggcctattagagcctgcccagttcccgggagggccaaccccagccagtaagaagacctgaggcgtaggatccctgcgcaggaggttgcaggaatgcccccgctagccgcaaggttcctgctggcctgtagagctttcgtgatccccgccaagatgcgaacagtaaggtcctcgtatggatcgcagtttttgtccgaaacctgaaaacactaacttgggatttcgcagttctggccctcgggcccgcctcggaggcgcacccccaatccccacggaacgaattccgcggctaaaatgcattttcccaaggcagtaaaagtgacccctgcacctaacaacctttgggctttctcttctcctgactaccacctctcgcagggtgcgctgaaatctctttatcgttatcgttttttataaatgaaatgatttatttattcgctgtttgcagggaatgaaaggagttgatcctgactccaagatgcattccaaagaaagaaaacgcaactgtagcccggactccgcggaggaaggccaactgactccactacgtgcacttccgagccacttgggcccagctagctgtgttaattatgggttctaattttattgcaactcggcacctcctggtttgttcccactatagtggtcttaaaaagaaacacacacaggcataccccagaatgaatccccgggaaggcaaaggtagattttttcggtgcttgagttgatgctctgagagcgcgctgagagtctcgggcatgtcttggcactcttggaaacaaattgcagccaagagcacggttcttccggtcctctccttgctcctctgtgcgccgctcggccgcgggactcctggaacatgttgtgcaccgcccgagtggctgcggacctcacctcgacgccctggatagccggggccaggaggagacgagcaggcagtctcccgccctcacctagtcagctgcgacctccgcggcgtggactcttggccagcagtgaggaggacaaggttgcagatcctctttgctgcgggttctgggtccggccttgggcggcattctgtcttctaaagtgtggaggtgggtagaagagtgtccactttcagtgtagacacctgaggtatgggggcttctttgggggctccagcgtgagctgctcctgcagattagggaaatggagagaacaacaatggggacatggtggaattcagatttccccctgttaattaacaatatgatttcgcttagtccaagtgtcttctgtgttcttatttaatgtctcttgtaaaatgggaactagaataatacctccttggtatggttgttgtgtttgacgtgagccctcaacaaatggtaggatgaactggagaagaatgggtccatcactccccacacccttccctgcagagcttctttgctgtctccagctctcccgccctgacgcaaggacagctcacaaccagtgtccttgagtagcccctgggggccgcaagagaatccgcccggtagggcatagaagatgggttttcggtgaatcgtgaaaagacatgatcgggtttcccttggagcatggtggagaatgatgcggagccttggggtcaatggagagttgagggtgcagagggatctgaaagggggaaccaaaaatatcgggctttgaaattctgtggattttcaaaggcggttcccaaccttgtcaaaaactacagtgggtgcgcgatctaatctggctcctataggtggcgctgtgacaaggtgcggtggccgggagaggcggctgggggactcgaagactgcgggaaattttctgcgactccgacgctaacccgctgctcccagcctccgcttcctgttttcgagggattagctaggactgtgcaacaccagtctccgctctcggagtcggcacgggggctggtgggtggcgggatgaactcggggaaggcgacaggctggaaacgcagctcctcgactttgcagcgcaccaaccccctatcgccccgtccgctgctcaggtgcgaggattcgccagacgccacaggactgggggcgactcgcaagggcatcatgccacctagaggaaacgcgcagtgagtgagccctgggtcactgaaaatgggagaacgttcgagtcggtcaagatgactccggcctgcgagttgattcagactcctcggaagccagaaattgggtctagagtgggttggtccctccgtcagcagttcgggcccagccgaagcttggggcctagagggcagacgtccggctctgatcagagtacagcgggctgggcctggcagcctgcaggcaacctggaccttgcaataaagctgcattcaacataactcagaccacagtgggagcccccgaagggcttcatgtgagtcccgaaaccagagtttagaggcgcggcctggttctcgtttatcttttccagacagcatttaggccaataaggtctttgaaaggaggcagccccaaagccctcaggccgacacctgagggcagggtctcaaacagctgtgcttgaagaaccggcaatcttgcttttcccacacgcagctgcacctctcctgagcgctgcagctgatggctgtatagtgaccacggactgcgtcctcctcacgaagctgcgcaacttctgctaatgctgcaaccctggcaagacgaaatccccctccctctggctagatcagcccagcctcccctcagggaccttcctgcccctccctacccctccctacccctaggccgctccccccttcctctgttgggatccgatccttgttcgctcttgcaatcccgcagcccggagttttgccccgtgcattaaaacatgttctctttcatttgcagatttaataaacaaacgtaaccatatcacatggagctccacactgtccttctgaaagcaattccgctgttgaaaactgaaaaatgggtgtaatttgctttcagaaagtaatgttagggtcacggcaatttctcgggccgttatttatttttactttaaagtctttaggaaagatttgcttatatgctcggaaaacttccaaatgcgcgaataccagcaatcccgctcgccttcaacgcgtggggtaagggggggtggggaacaattactgagtgacgctaatatggggaaactgaaaagaaatgtcgattgtttttattgtaatagaaggagtgagcaaacagaaaaaccaaccccgggtgatcggaaacaggcaggcggagaattaaaagcgggtttcagacagcaacaggcccctcccctgctctcgcaaggagaaagcgggcgacgagcgctcgcagcccgtggggctgatcccacctcccgcagggctccggtcgtgtcgctgtcggaccgcagaacgccgggacgcatttccgagctcgggcccgacccaacccgctgccattctagctacctagtggagccgcggagagactcttgaaccgtgaggctccttgatgagaaggtggagaggctgccgggctattctccgagcatcttccggccgagctctgctcctctccgtgcgcttgcggcttctccttgggctagcgcgtccgcagtccctccaagtccaggccgcaggtcagtgtgcgggcgcctcctgtcctcctctcccaccagaggacccctgagggctgtctccatccccaatccccgcgactgctccttttagccgccatcccctcccgcagcgcagatcctgcaggggccagcggtccagggcggaccctccctcgccctgggcgcggggcgagcttctggctgtcacttgccgctgcagtttcagggaaactcagctggccgcttaccctgcaagacggggacatagcagagggccgagttctggagaagctgggcttgtttttctctctgcaccgcgcgcaatgccccaactgaccctgaagggtcttgcctttactgcatttgcccccagacggctagaagtcaatgcactatgaaaatcccagtcccggacctcggactctggctgtcttacaatccctgcaactcctccgagtggacaagaggcgggcaccgtcgcctgggcctcgcttggggggggggggtcctgtccccagcagggggcaagttggaggaatcagctccttaatattttctgctagctctgcttgtcataactgcaactcggaatagaacaacctctctcccgtgcatacgcacccccaactctcgccctatcctcccatccacagtcatcactgacctgtagacccggaggagcaggcttccgggggtcggtccaggttggggatacagggaggggtcctcgcgttccgcacaacctgtagtgcttgggtctgacttcggcagccctcgggtacagtctgccgggctagattcccgttgcttctccgcgtctctccgcgggccgctctagcgccgggaagggggcgccgcaggtgactgcccgcggcactgggacggctgacagatttatggagacttcacagcatctggctggggtccgcgagggcagggcggagtccggtcgatccgatgctggggtctaaagcttccccagccacacgcctgggccgagtcgcccccagagtccccggcccctgctccccttgggcgggtgtacacaaggatccggccagcgccgagtgtactggttcctcccacccagtgtagccccctccttcacactctcggcccggcttccagtctcccactgagtaaatatttatccagagagcgagtcgcccctcggaggaggcctcgacgcggctagggaaaggctttttggcttctccctggcctgagccagctgcaggccttactggtgttttggttttggtcttaaatttctccttttagtcgaaattcttccgatctctttgagatcttctgagtccagagtgagcagtgtaaccaggcggcagactccagctgacccttgttcttgttctaggtcctgcatccttacattcatcgggactgaccagaccttagtgttctctcttttccttccttcatcctctttctctgcctcagatccgtcgtctctcggtcggtctcagcgggtcgctgactacctcgccctagcactcggtccgcgccccgggaaggcttcagcatcaccctcttctgctgggatcccgctgaccctgtctgcagcttcggcttctcttgctcccagagcggggtcttcggcttgccgcggatacttagtggcccaaaacacctaaaattgactcttcctgcgctcttgagaatgccaagagcacccagtacctgcaaccgccggcatgagtggggcctgcggggagccgccagagctgcggacaggccccctgcccactgagttgctacccctggcacgcccaggggatccgcagcagctgaggccacatggtcacagccaagttcagcaggtggaaagggagagatggcattgaacctatgtgagaactgggaagatgtgtggcagctgaaggagttggtaggaacaagagggagttgtatgttacctccatataaccagagctctaaaccatatcagtttctgaaccagtctaggctggtgctgcagaactgctaaagctctcgcagagtccccagaccccccgcgggacatgaggtcttgcctgttcgtatgcgaacatccttgtacccgcctagcagccctgcagactgcaaattttccctgggtgcacggaagtagagcagatttggcgcagaggtcgatactcactgcctgtctgtgaggggggaggaggattccttcctggtcaagttgccgggcatgttcattccctcccgcaagcctaaggcagagtcataagctcccctacgatgcggcaaagtctcaactaatttatctaccagccttaagaaggagctgctgcttctaaaatctttagatttccgaaggctctccttgtgtaaaaatgccaggcggtgccacacgatgtcacccaacaggtattggaggtcagaccaggctgaaattgctatcaagtcaaacttcaagaagattttaaacatttgaaaccaaccaacaaaaagggacaagttcaagtatgtctagttgtgggatttcccccaagattccgattctaaagagtggtgttttagttcatctttacctttcacatcctccattctgttaggtaattttgaatttagagtgcatcctaaccatagaagtgggaatctggagatctgttcctttgcagaagcatggctgatcatagttttttcctgggttcttgcaacttactgacctgagatctgggaccagtcagcttctctgggtgtagaccgcagccacacacatccctggggactgttggggaagcagcctgaatcctgtgtgcacaaggagccttctggattgtcaagtagcagtaacagagttcacgaccccaagcagtacaaactcccaaattcacgaaaatatttctcttcttgtttattattttgattcacattctccacaaccctaactgcaaatattaataactttggctgcaaaaaagcatacggtacactttagattagacttacagtgaataaaagtgaaaattcagaagtaggcagaacgacagggcctctggagcttaatggaagacgagggaattacatccatgtgcagcgtcggtgtccactgtcttgggactaagtctctttcatatttaaacaaaactctttcgagagggctcgctggtttggagaaccctcacaaacgctgccaccgagggccaggggcccaggacagtggctgaatgtggcagagccttgggctccgtagtgagtgccccacgcactggcaattggtcgacttggggctgtgcgctagcgttagccgcctgtggttcagttccccgcacacggcgtggcccgtgcctcgagcctgtgtggctagtggttggccggtccacctggactggggggtcgccgcaggaagctggcggtaggaggaacctccctggccttaacagtggcccccacctgtggctcgggctccccgcaacctcctggtttctttggccggcctatcttctcacacctgcgctctcgccacctggcatggactgaagtgaggtagaatcggcaggtgacacagatcctctcctgacagtccccagaggcccgcatgacagattttgctaagacaactccctcacccctgtgcacggtggcgcccgcctcccacctatagccttaacttcaattctgagatgtccatcgttccccggaggaggtctcctcgggccccttctcccttcgagtcattcacattcagaccaaacgctttcatttgtttattcagcattttaccagcctgattttgctgtctttttgtgccgcttctgggaagatgtcaaacacccattttcattgtatttagtcacccaggtggggagctagcctgaaagagacagcggaaggagtttcctggactgcgctgtcgctcaccgacccgcaccaatcaccatgcagcttgccctcggacccgccccttttagggcgtgtccccagtgagtgatagacggagccgccctgccctgctcagcccagcccacgttgctgcttagattgaaatgcagaactcaagcctctttcatcggggcacagacttccttttacttcttccttttgccctctcgcctcctcctcctgggaagaagcggaggcgccggcggtcggccgggatagcaacaggccgggccactgaggcggtgcggaaagtttctgtctgggagtgcggaactggggccgggttggtgtactgctcggagcaatgggtgagtggcggcgggggactctgtcagagccgggaagggagggagggagcgagcgggcaagggagggagggagggagggagcgcgagggcgcgcgccactaggcgctcacattctctattgactttgctcgtgttcctacaagttgtaggaacacgctaagggtcagcggcgcacagcagttcaatgtgaacgctggctactgggtggctgttgatgccattttctgattttaagagaagggagctgtggcatcagcgagcccctcagcccgagtagcaaaccaagttttgtttcacacgcgcgcacacatgcaaacaaaacaggaaaagaaaagaaaagaaaacaaacaacaacaaataaaacaccctctagcttcccctagactttgtttaactggccgggtctccagaaggaacgctggggatgggatgggtggagagagggagcggctcaaggactttagtgaggagcaggcgagaaggagcacgttcaggcgtcaagaccgatttctccccctgcttcgggagacttttgaacgctcggagaggcccggcatctcaccactttacttggccgtaggggcctccggcacggcaggaatgagggagggggtccgattggacagtgacggtttggggccgttcggctatgttcagggaccatatggtttggggacagccccagtagttagtaggggacgggtgcgttcgcccagtccccggatgcgtagggaggcccagtggcaggcagctgtcccaagcagcgggtgcgcgtccctgcgcgctgtgtgttcattttgcagagccagccttcggggaggtgaaccagctgggaggagtgttcgtgaacgggaggccgctgcccaacgccatccggcttcgcatcgtggaactggcccaactgggcatccgaccgtgtgacatcagccgccagctacgggtctcgcacggctgcgtcagcaagatcctggcgcgatacaacgagacgggctcgatcttgccaggagccatcgggggcagcaagccccgggtcactacccccaccgtggtgaaacacatccggacctacaagcagagagaccccggcatcttcgcctgggagatccgggaccgcctgctggcggacggcgtgtgcgacaagtacaatgtgccctccgtgagctccatcagccgcattctgcgcaacaagatcggcaacttggcccagcagggtcattacgactcatacaagcagcaccagccgacgccgcagccagcgctgccctacaaccacatctactcgtaccccagccctatcacggcggcggccgccaaggtgcccacgccacccggggtgcctgccatccccggttcggtggccatgccgcgcacctggccctcctcgcactccgtcaccgacatcctgggcatccgctccatcaccgaccaaggtaggggctcagaggctgggcgtgtggatgtgcagcgtctgcccccgcactctcgcggaggtcccagtatctgcagcctcagggacactgtctttcccaccacctgaggctttttcctttggaaacgtaaggagtcttcctagggggtgttctgatctcattaacttgaaactcatgcccctggtttccttgccacacacagtcttctgcctcatctcaaactaccagacccataacatccccccatccccaacacatggttcgcattttccaccctcccccgcctctcgcgccgaggcagcctcagcccggcttgctcacttggagagtgcggccggggctggacttggggcgcagcccgggaggcccgagcctgcttggggctgccggctgcagactccgctgtgggcagagcagcttgcttggggatcactacggccgggagaagtctggccgggaggagtccagcacgccttggaaattgaagtattctccgattctggtaatcaggccaaatttgctcaggcaggaagttcaaatgtcacctaattggtttcgttcttatgcttcacttcattttcctcggaaatggaggtcccgaagttactactagtaacttgcatgtaactcattcccagacgaagtcatattcacattctctctctctctctttctctctccattcactttctaacttaacagacttcactgtatatatcttaggaagggaagtggcatcagccactgcagtgatggagataaaatgcaggcaattccatgctgtccttttactgttcttttcagttttccctgagcctgccactttcctttggggtccccgggtccccgggtccccgagaatgcaagtggatatctatctagttcctgcatgttttaagcagtgccaccccactgtttctttcctttctcacccctgaccttgcctagtcctaagcgtcctttctgccttgtcagaaggattccccgagccctcctgcccagtccggcttccgca

SEQ ID NO: 19 - DNA, 9498 bp, Homo Sapiens
tatgcacgtgcagacaaaccgggttccaggaggatgacttggcccacccccactctcacatgctttctctttaagttgaggaagaagagaggaacatgtattcaatgatatcaatgcgccaggcactgtgccatgtgcttatcccagtgcattcctcacaacaatcaatgggaaataaatgatcacccccattttacagatggggacaccgcagtacagagaagttgagaatatctcgtggtctcagccagcaagaggcagaggcgcattttgaatctgaggccagggcctgagcgctatggcaccaggttgtgagggagtttactgagcaccaatttcgtggctcaatgcttttcttcttaccctaactctgaacgtcttcaccagaatccaaggaggcagacagtagtgcaattccatttaagagccgccgaaaccgaggctcagagggctttagcgaaagggttgcgcttggctctaggcacctgggctgagtctttttcccaccatcgcagggcgggaaccagcggagggggctggctcggatggggagaaaagcaactggagggcgccgaggggaagagggagcccggatctgtcagggcgtcctcttggactaagggatgttcccctaaaccacaccaccccacctcgttcagattctgggaaacccggcacgcacataccctgcacaataacaggcagggtgaggtctctaagccccgaagatcgctctctcagcggaggcagtggccctgacgagggggtacagctgcacgcgcggggtttctctccgaaccggagtgcagcgtagtcgaggtccaggattccccatccattattcacgatgtttactagagcggggcaagggagaggaaagaagagggaagtagagagaaaaagaggctaggggaggtggaggcgggcagtgctaacctcgagagccctcaagttccgaaactttgagaaggaagaccaagaggctaaggcgcctgggaagcagcaggccgtcagtaaatatttgtaagatggatggataactgggtgagtgagtgaatgggctaatcattagcccctctgatccttgttttcctcatctgtaaaacgggataacatcacctactccatacggtgggtatgagaatcccatgggcaaactctaaattgtctagcacatattaggaactcttaaacggtagctgttgtcacgaggaatgggcttgcaagctctggctgcccagcagaaatgcactgaaggactcccaggcctggagggccatcctgaacagtcgctattctaaaaaaaatactccacaagcttccttagacgggagggttggaggaagagtgggccaagttacatccctcaaatgaaagaaagaaaggcaagcgtggggaggaagccaccccggactgagaaggcagttactgcccctacctctaccccggagcgcggttgagggaggtggggcaggggtcacctgggcctcgttctggcagcccctcaccctctccagggcccgtctgggcgcttggaggcgcctcctcgctgcgccgcgggaccggactctggtggacagcttgggcgtgaggccaggagcgccctggaaatgggcagtttggcggcagccgggccgacggagtgtgtgtgtgtgtgtgtgtgtgtgtgtgtgtgtgtgtgtgtggtggagaggggaagttggagtagggtcaacttcctgccccagctcagcccagggctacccttttatccaggcagttcgagctgggacaggacggagaggttgggacttttggggtggcatgggggaagggaagtccacgaagaagaaagaatcggaaaggtctggcgggttggagccagcggggcggggcggactgggagaggccaggccaggcccgggtataaaggctgtggagggggcggccgccgcgggcgcagaaaggcgcgccgctagctgctgtctctcctcacctcccgggccgcccctgcgagtccccggcgcgtgagcacgcctgcgcgcgcccgggcccttcctggcaggctgcttgtaagatgagtgaagaagcaggtgggggagaggggaggcagcgagcgagagggcgaggggagcgcgggcgctgagcagcgctcacttggagagcggcaagcaagctagacaagcctgattccatgtcacccgctgccaccctgccaggagcgcgaagatgatggccatgaactccaagcagcctttcggcatgcacccggtgctgcaagaacccaaattctccagtctgcactctggctccgaggccatgcgccgagtctgtctcccagccccgcaggtacgtagtggagcataattaccgctctaaggcacattttttgacaggcactagcttcatgtttttttcatgtcgcccagaacaatcgccgctgtctgaacccctctccttgtctcccccgcgttctctcccggcgcgctctctctctcattcatgtctctgatccacacgtctgttccagcagagccgctgcctccgtattaatttttatgacctgggctttgaggagaggcatctcggttgcttgaaaatgtgttttaatcctgtgttgacagtattccctactgaccgtgctgtgcgccttctcgcttgcagctgcagggtaatatatttggaagctttgatgagagcctgctggcacgcgccgaagctctggcggcggtggatatcgtctcccacggcaagaaccatccgttcaagcccgacgccacctaccataccatgagcagcgtgccctgcacgtccacttcgtccaccgtgcccatctcccacccagctgcgctcacctcacaccctcaccacgccgtgcaccagggcctcgaaggcgacctgctggagcacatctcgcccacgctgagtgtgagcggcctgggcgctccggaacactcggtgatgcccgcacagatccatccacaccacctgggcgccatgggccacctgcaccaggccatgggcatgagtcacccgcacaccgtggcccctcatagcgccatgcctgcatgcctcagcgacgtggagtcagacccgcgcgagctggaagccttcgccgagcgcttcaagcagcggcgcatcaagctgggggtgacccaggcggacgtgggcgcggctctggctaatctcaagatccccggcgtgggctcgctgagccaaagcaccatctgcaggttcgagtctctcactctctcgcacaacaacatgatcgctctcaagccggtgctccaggcctggttggaggaggccgaggccgcctaccgagagaagaacagcaagccagagctcttcaacggcagcgaacggaagcgcaaacgcacgtccatcgcggcgccggagaagcgttcactcgaggcctatttcgctatccagccacgtccttcatctgagaagatcgcggccatcgctgagaaactggaccttaaaaagaacgtggtgagagtctggttctgcaaccagagacagaaacagaaacgaatgaagtattcggctgtccactgattgcggcagggcgcagcgtcgggagccgggagagcctagtgctcatccctcccgggttcgggggatggttatcgggaactccaaggcgtttcctaggcaggttaggctctctcctccgaagccacagactttccccctttgtcccgcctggttgcctccggccttctctctctttcctttctattcccaccaaaaaaattttggcgctgggaaaatattgcagaagggcgggcctgagtgtacttgtgctgtccgtggtgctgaaatttgccctcgcgcaggggccgcacgacttcagagcaggagccccaaagcagaggacagtcaattggcccaaccgcccgaagctagggtgaaaatgccactttgctaagcgcgattaggcaaagggtgaagggataaaaaggaagtgatcaataataacacaaagtctaggatatctaagggggacacaaacatgcactggagatttattagagtatataaaatacatgtatgtttccaaaggatagccttatactcccttccttgcctaaattctattcaccttatcctttggtttggcgtaaattctcataaggtagcatgaagattaggttcagggaaagtatgcagggagttgcgggctccaagttgccattttttcgtggtaagtagggctccaaaacaggtgggcccagtctggcgactgaaaattctgggatcgcttggctgtttgtaatcagctgccagcaccagctctggccatctttcactacctactggtgtttgaggggtaattactgcttgctggagagcgggagtttgtagtattcataaccgttgaggactctctgaccccagctcgctgctcttgccagattgccagctcagcgtgcagtcggctgctggaaaacgactgtaacttctctgcattatatgcaagtcctttcaacacgtctaacctccttgcacttttgttattactgttgttgttaacatcgttcattactattatttatttaattctgcttctttccattccctttatgtgggtgtctttcggtggaagttcacttatagttttgtgagggaagaggagtgggaccatgggcctgaacccttctcaccctgcccctctagcccaaattttattttattttttcgttgtttcatgtagtttgtgtgttgctgtgtgacctttggtttcattctctgaatagatacaaataaaatattaagttttcttttccctttaccccttgaattaacttctaaaataaatgctttatttttcaacccgaatcaaagtggttttattttttctcagaggctaaggggtactagctttgaaaaggatttaaaaaggagaaccccaaagggttgggctgtcagtttctgctgcccagcccccagccatcccttctccccactcctcttccatggcagactcacttggagctcctcgtgggagaccctgcggcttgtgtctgaacttgaggtttcaaggcacttccttccatgcttccctgcctgccatcatgagactctgctcaatttgacttagctagtaaactttgaagccggactaatagaaattcgagcctccaatgcctctgctcactggcagaaccatcctgaggctaatttcttaatttctctaagccttctccaacaagattgcttgtctgcagaatgaagggaccaacgcttatttcacaaggttattgtcaggactaggtgagattgtttatttaagacgtcaactagtgcttgggttttgtaggcaacaaattattttaaaagattcaaagggcttgaaaggaggtgaaataatagaggcaaagagggagaaaagtgttcgctgggacactctagtgggacccactcagagttccaaattcatctgaaattctcatccaggttgttattcactctggggtccacctcggcttctttgtgggggtactgctataactgctgcaaagcgcctagcatagtgccctgtacatagtaggtgctccatagacgccagctccctgttctctttacgctccctctttttatttgcgagctgtagaaacgccttcctgatttaaaatttaatgctccaagtccaggagtcatctgcacatttccctgcttcgtcctcaaagagttgcgggtcatcaaaccacggggccgaaattcggagcagagtgggtttgccctccgcgcagtgcgacaccccctaccgcataagctaacttgcggatctcccccagctccctgggcctcagccctttacccccgccttgcacaacagccccagcgattcctccacctccctctccatcgggtgtcctttaataataaatgcccttatgccattacattatattgtgggttttgaaaatttaaaatacggctgatgcaatattaattgcctatagtggtataaaacacagggcaggagcccagccgggctgcagaggagacaaccgtgagcgtcccgcgccgaagcgaagcgctccagaaggacgcgcttttgcgggctgcaaggtttcctgcaggtaagaagagccttcgcatgttcgggctctggagagaaccggaaatctgcctccatcctcttttcgaaaagttctctgccgttatttatttagtctttttttttcttttaattgacaactgcaaaagtttgggagacttttacggagaggatgagaggagctgcctcctgagcgcaaggtctgctccaagacggtccagtagcactaggtccagtctccgagccatgcctctgagcctagtcttcttcaggcgcctgagacggtgatgcgcaggagtattttcaccagttcctacgtgcaggccggagctgcagcccggtcagcgaagcgctccaccctttccctcctcctgagtgcgccggaacggcgccgtcgcctcactcttcggcttgcttcaggaagcaactggagatgtggtttccccaggattgtgtagtcgcctttgccactcgtctggcggaggcacagacctctcgggggaggggaggtggtactagcaggtctggggtttacacaaggctagtatgcatccgaaccgtgtgaccttggacaagtcatatcgcctctctaagcctctgctgccagctgtaaaacttccccaaatttattttgaagagtaattgagggtgtttcctaagatcacctggagcaggttttcattttcctaattctgtcagcttgcaacacgtacggtccaagactcagctgagagtttctttaacttgtaccaagagaaagtgaagtcagtatttgggggtgtttgcatggaaacctgcatcgggcctccggagggtgggactttgagaactacctggctggaacaggggcttcatctagaatgagctaggcatacacattccagcatgactaaagccctggtaggcagaacttggtggcaggagtcctgggctcctgaacggtgttatctctggccagcgacttcctctctgtgtgcctaagtagtctcagttttgttcactacttcatgtccagcactctgctcaaggtctggcctagagtggcagacactagatgtctgttgaatgaatgaattaggtttttgttttgtaaaatgaaagcaccccttccagccgaatcccctctggattcaagggactgtagggaggaacagagccatcagggataggcaagtctccctgggaatggggatcggggcaaggcggtggtctgcatcacaggctttcattcaaggtagccagtgtccttcttgtttaaatagaagagactgtgcttcaccctttggtggttatgggtacacaggggatgctctgtgacatggcccttggaacctagaggaagagccagggaggggggaccagggagtgaccgctgccctgcccagtgtgcctgacgtttgagttccagttcttttactgtcctcctgagatggaaacagctccggctctggaatggacacacctggggtggaataactgctccatctcttacttaagtgaccttactgctctgaccctcagtgtcctcatctgtaaaactggaaaaactggaaaaaagactctctcaggattgctctgatgattaaatgagatcacgtaaggccagggcctgacacatagtaggcattaatagatatttcgttgctttaaaacattttttgtactcagaaaagtgaaggcactgttgtggggcaagttcagggcttggagtcaagtggaatcaacattttccctctgtgagccacagtctggtcagggtagcagtgcctatcagctctcggagtggttgtcacgggcaagacggaagcttaaaagaaaccgctttgcacactgtgcgtcccagctacgcaaggaacgaagtattctctccctgggagtgcctggtgcgaatacatagctcccactgagaagcttggccccggtcagcggctccaggagcccggaacctcctccctggcggaatcccgggcaccattcagccttttcgaaggctccagacttcgcgctgctcctcctcccgaggaggggcggggcgccagagggcaaaggagaagcaagggtcttggactcctcctccttcccagcgaacatcccttccccgccctgttcccactttttggccccggcgccagaatgtttgagccgaaggggcagaacgcctaaaagccgtgtttgtttatttatttatttatttatttatttttattttttaaatcgaagaaggcagtgaggcctagagagcaggacggacttagctggctccttttacctaaaacagctcttctccaatcacgttatcacaccgcccgttttatttctttcctagtctttaagactgcctgatagcacctacccagttcacccctgcctccctgaactcaacgcagggcctcgcacagaacaagcgctctacaaatgtttgctggataaatgactagtgatgatatctaaaacgtatggcgggattcccctatgcgaggtactgttccaagcgctttagcgcattcgtttgttaattcctaaacaacaccatgagtaggtacaatttttaattccattttacagatgagaacatggaggcatggagagtttatgtaacttgcccaggacaagtcatgaacacagccatttagtggagagacctggcaaaaacccggtgcctttgcttcttccgttctcaagtgagatcacctctggctggggtggggaagcggaccgcctgggagtgaaggaggagcaggtgagtccgatttggcaccagattaggcagcgcgagcagaggaggtggtgggagccgagaacgcccgctgtcctcgccgggcttcggagcctccacgcctttgtgtcccgcgcgccactcgcgtctcccgtcctgtctgtgtgcgtctgttcgcgtgtctctcactcagcccctcttagcttccctccagcctcgcgggcgcgaaactctggcccccatgtgccggagcgagggggcccgcgtccccgggcgcgcgcagagtcgccttcccctctttcctctcttccgcagagcggcgggagcccccgcggtaaccccgccccggcgggcagacggagccagcgaggaccccggcggacaaattagtctccccttcgatcgctcttttccgatcaagtcaggtttcccctgttcccccgacggcgcttccgcactagcgcgactcccagggctccccggctgggtcagggttcgcccgctcctcccggcgcctccggataggggcttcccttcggctgcgtcccggcctgaggagtcccctggaccgcgggaggggcgattgccgggtccgcgcggctcagaatcctccccacgcgttgcttatacctttctttgtaaactgtcagatttctgccccctccctcagttcagccctgcgcagccttgcctgccactggaggcaaactgggacagaaactgcgctcgctct

SEQ ID NO: 20 - DNA, 12727 bp, Homo Sapiens
gggcttcccctccgcttgccctgggtttgatgtggttgtatcccgtgctatcagaggagcccttccttcactcaagtgtgttcccctgcccagctctctccgcagactcctgctgggctgagctttccctgctcttaagagtcaggagtggctcttgctgggatggaatgacccgtctttggggctgcctcatgagcggctcttgtgaacccggatcagttccgatgtgtaaactctaccgcctggccttcagcgaacagatacagatttctgccaccttccatgaccctacagttcatgggactgggtctggggcagtgccagaggcacgcatggaggtgtgattctaggtgagtcctgcggaaaacctctggcccacccgtgagtcacggacagaacatgcagactcaggccttggtgacataagctccgcattgctaaaaccgcgtgacctcgagggctgactggcctgagaaccctggatggcgctctcggccacccccacctcccaccccaacctcctgggcttcggtcagaatccacagcccgtgcccgaagagcgcttcccgcctctggcaccctaccttcgctcagctccagggaaaaggggagagggcagctttctgcagtcagaggaagagtacattttctttggctgctctaccctctgaagtagggcggccagctgaaggaggacacacttttgaggggcccagaggttgtccaagcttccccctgccccctgaagactgtgcactgagctgggcgcagttctcgggaactgtttccacccagattgctggggggcgggggggtaggatgagggcagagccgagaggctgtccaaggtttgggagagagaaaagtttctcccaggactcgaccttggcctccagcaatcgcgacagctaaaaacgggtgtctcgcttcgacaatagatccccgcggaccttctggcacctggttcactagcgcccgcgaactctgcctcgggagacttattgaaatccggatgctcaagccgggaggcgcgcagtaaccaggaggatgagagggccgggtttgggctaggaaagcggccttttaaaacagatgtcagggggactgcagccccgagccatgagaaaaaagttaaaggcgagatgacacgcactgaattggggcaaacattggaagaggagacaaaactgcgtgcttgagcaccggggtgcggggagggggggacaaaacccgtatccagtgcaaattaaaatcttgggagtaggtgggggctgctgcgcgcccttcaccctcagttcccctattaaggattctgagtccccatgcactcctgtcctctggctccttccttcctctccgctcggccggtgagaggcggccgccggcgccccagcagcagctagatgtcaggcgaagcccggagcgcggagcgcggggaagggaggggaagggaggggaggggaaaggaggggtggggcggggagcgcgcgcgggctcggccagtgcggggtggtgggcgggctgagcccggggacggcgcgggaggggggagggaaggggggcagctgtgggcagggagccgggctcggccgccagcactaaagatggagaggcgccggggccttgcaggggagggggctcggcgttgacgtgggacgcggcggaggcgcagcagccggtggtgatttgctaacctcgcagcagagaggagttgagggcgatgagagcgggtactgcgaactgccgggcgatgctgtcgctgccgccgtgatacggagagcaacagttccccagcaacacccctccccgacacaggcacacaccccccgacaggcacgcacacccaccccacagtgcccggctcggctgcggtgagtgaggggccgggaagaggcgcaccgcccagcgagcgccgcgcgccggggcttcccggggctggagaggtctggggggcgcgcgctcgcttcggccactcggccgctgggcttgtgccttttttatttggcgtgttcccttcctgccgctgcagccgtcgccgccaccggttgggggtcggctagaagggggagccccggctgtcagcctgggcgcagctgcctccccagcccttcctcttcagggcacggtcggggtgagaggtggggggcgtagcggtgtgcgggggctgagggcgtgagcagaggggtcggggatccggaggctttgtaccgccaggggctggcggagcaacagagcccgtgggtgctcttatgtatgcggaccggtgcgcgggcgcaagataaggttgtggtttatttatttgtgtgtttattcgccggccggctgggaagctagaatcggaggagctgacgagtagatctgggggcggaggggagcaggactgggactgcttacgttttgtttctctttgagaaaacgtggtgggctttttcttgattggacttgatccccaccccccttttgcaggggagggagggaagctccagagggtctgcagcgctgcgggccctcctcggctctcggcgggaccggcggtgacaccggagctcgccgtgcgctcccggccgctctcggtgggtgccggtctctgcacctgatgcgttcgggatgcctttcccaccctggcgcgcccgccgctagctcgcacagcgcctcgcacactcccgcacgcgcttgaaatgcgcacggtcccgccggcccgcggaaccacccggacgcacggagcgctccgcaccgactcgctcgccgcctccccgagacgctcgcaccgtgcttgggccgggcgcgctggccgctggcgccgctggccagaggcctgggacccagccggtcgctcccagggggtcacggccctgggtcggagagggagggcgggcagaccccttctcgcctttcctcccacaactcgctgcggggcttttgtgcttccccttcgccgcggggcgggtccgcctcccctgccgctctcgccgcggagtccagcccgcccggactgtcgccgttcctccccgtctctttcgctttccctcgtccctagctcagctctccttctttcaggagtctagctcctcgggaaaagttgcttccccaagtttgctgaagtcgtctccaagtctcggtgggggtcgctgggaactgggggggtgtgagagcgcggtcgatccccggagctcgggcgggttatcgccggctcttccccgcgccgcctggctggacgctgcagccagcgccagccggatcgcgggcgccgagcggcgggtgggggagacggctgcccgtgggcgcccagatttccctcaggacccaaaaggcttgtttcagggcgccaagcttccattcttttggctgttccctcctagttctcagaaaccccgatgtctgcgggaaagcacgcggtggctcggctcggctgaatgctcatcccaaccttgacggcctccgtccccaccccggggcgggcagcaaaaatgtcttgaccagccgtcctgtgaatcctttctgcgtgagcttggtggctcctgaactgatagagctccttctgggggtggaggcaagcaagcagtgttcgaagagtgagggagagaccttgctgttccttgctctcagtgcattcactgcaatattggtcgctgtaagacagacacggggagggtcctgggcctgcgcggtctttctaacactcctgtaagcgaggtttggagtctaggagccctcttattgatcccgaacaggctctgggagaggcctttgtttcccagccctgtcttcccttcgtactggttgtaactcacaccacaggtgctggtgccaatatcacttccagcgcctctgagccatgtccagcatcccttgctgcccctggtcacaggacttgcagactccttggagcctgtgggacacacgtggagttcacacacccagcccagcatgagcactcctggctgtaggggaccatatttaactatggtctctctccataccttaatgacccatccttcttcgttttttagatcctcctgtccaccgggcagttgtgggcaggagggtaggtacgacaccttacgtaagtgtgtgtgtgtaaacacacacacacttttttttttttttctgagacggagttttgctcctgttgcccaggctggagtgcagtggcacaatctcggctcacggcaacctccgcctcccggtttcaagtgattctcctgcctcagcctcccgagtagctgggattacaggcgggtgccaccgcgcctggctaattttgtattttttgtagagacggggcttctccatgttggtcaggctggtctcgaactcccgacctcaggtgatccgcctgcctgggcctcccaaagtgctgggattagaggcgtgagccaccgcgccctgccccacacactctttctgtctgtctctggctggtgtacatacacacagttcagattttatattatacatacaataactttgaggcttccgtgggtagaaatgacccaagttagtgtgtgggttgtgtgtgttcctgttagtacctagggatggggacaggccttgggtctgccagtgctttgcagccctgagaacagtagaaggccagaggccaaggctgatggtgagaggatagcctttgcggaggagagcccagtgtccatagatttctgtggccatggctacaggctcctggcctccaatgagtttgactctgcttctggggctcctgtagtgaggcagagtttggaaaaactgtttaaagataaggcttgacatccagggggctggcgtgaagctgacaaggaaggggctaaagtcttgctaattttaagtaagtgcacttcatcataatgaatgttggccttgcctagggagcccctactctcagacacagagaaagctgaggacttataggacttcactacaattttcatttcacttcatctaacagatgtcatagagtagtgaattaggcatctgctgtggcagaaccttctttttactctcagcatccctggcttgaaaggcagatttgtagatttctaggaagctacttcaattaaaatctctaagatcctcttgctaagggcttggcaacagggaggagggggcatgttgtagtggttgaattcttacttttagggacactgatgaatttgtcttttgttctctcatctcttttgcttcttcccctcttctttctcctagcctcctctattggcccaggaagcccacccagccccgccacgcagagcccagaaggaaagaaagcctcatgcctgagccgaggggagcaccatggatctgacaaaaatgggcatgatccagctgcagaaccctagccaccccacggggctactgtgcaaggccaaccagatgcggctggccgggactttgtgcgatgtggtcatcatggtggacagccaggagttccacgcccaccggacggtgctggcctgcaccagcaagatgtttgagatcctcttccaccgcaatagtcaacactatactttggacttcctctcgccaaagaccttccagcagattctggagtatgcatatacagccacgctgcaagccaaggcggaggacctggatgacctgctgtatgcggccgagatcctggagatcgagtacctggaggaacagtgcctgaagatgctggagaccatccaggcctcagacgacaatgacacggaggccaccatggccgatggcggggccgaggaagaagaggaccgcaaggctcggtacctcaagaacatcttcatctcgaagcattccagcgaggagagtgggtatgccagtgtggctggacagagcctccctgggcccatggtggaccagagcccttcagtctccacttcatttggtctttcagccatgagtcccaccaaggctgcagtggacagtttgatgaccataggacagtctctcctgcagggaactcttcagccacctgcagggcccgaggagccaactctggctgggggtgggcggcaccctggggtggctgaggtgaagacggagatgatgcaggtggatgaggtgcccagccaggacagccctggggcagccgagtccagcatctcaggagggatgggggacaaggttgaggaaagaggcaaagaggggcctgggaccccgactcgaagcagcgtcatcaccagtgctagggagctacactatgggcgagaggagagtgccgagcaggtgccacccccagctgaggctggccaggcccccactggccgacctgagcacccagcacccccgcctgagaagcatctgggcatctactccgtgttgcccaaccacaaggctgacgctgtattgagcatgccgtcttccgtgacctctggcctccacgtgcagcctgccctggctgtctccatggacttcagcacctatggggggctgctgccccagggcttcatccagagggagctgttcagcaagctgggggagctggctgtgggcatgaagtcagagagccggaccatcggagagcagtgcagcgtgtgtggggtcgagcttcctgataacgaggctgtggagcagcacaggtaggccccgctccagccccgcacctgatgtaggacttgaggccctcacacccctccttcacaccctggctgctcccaagttaggggcctggctcccctgtcttggcaatttgtgaaaaaaccagaacacttcttctaaagttctggcggggaggggagcaggttttttaaagtgtagtgagggggcctaggatctttccaaaaagcaccaggggacactcatgggcgcagcttcttaataggcccttccctttgttttttgcttttgggcccctgtttgttttttcggctgtttggtctgttctcctttgcttggagtgactgataaaatggagagaaggagaaaaggagtgggatgagggtctcttgggccctgcatctgaccatgttactaggtttcaggtcctcgggttcccatgcagtggtccctgtgaagacagcctgtccctttctgcagcttgggagaatgggagggtctgggggctgcttaagccacaagagcagctgcaggttctgaaccttattcctggtgaaagttaatctccttgctctgtctcccttctcattctctgatcctgcacatgcatttagggggaattgatttaaatgcaaggggaaaggatgggtataagagtcttggtcttgcagcctgtgaagtctcattcttatcccatctctgctcacactgaactaaatgccgcttcaggctagcattggcttccctccggcttccgtttccttctctatgaaataaccattcattgagctcttatgacatgtttggttcagtactaagcactttccatgagttgcattttcattacaacagccctttgagataggtaatgtccttcttttttttttggatgtgaagtttcgctctccttgcccaggctggagtgcaatggtgtgatctctgctcaccgcaacctctgcatcccgggttaaggtgattctcctgcctcagcctcccgagtagctcggattacaggcacgcaccaccatacctggctaattttgaatttttagtagagacgggctttcaccgtgttggtcaggatggtctcgaactcccgacctcaggtgatcggcctgcttcggcctcccaaagtgctggattacaggtatgagccaccgtgtccagctggtaatgtccttcttttacatggaacaatactaaggctcagatgtcaagtctcttttctagggtcacatagatagtaagaggcagagctggattcaaatttaggtccttaccccctggtactttgctgcctcttggagtcacttagacttgaagaggatcatgtctatggaacagagcgttttgaagattgcttataggaagtggagtaaataacaggggggataagtagcgagtttgttttttttttccttgcttctgtcataaaccacgtgcccatcattttatcctctagtttctgggtcagatgaatggagtcaagaaatccagctttctgttgtcattgacgacagcatttggctgcataccctgtggtctgctgttttgctgatcttgggtggattctccacttcctcccccttcacccccattcccctgttgctcgttcaggtacgggggatgtgagtgagaggggttggggtggggatatctggaagttgatctcatcacccctagccggaatctgctctgaccctgcctcctcgacagctcagaggcttaacttgtggaaagtgtggcagagctaaacgtagccgactttttccagtgggtgcgaaaaataaccgccactaaggtgtgtcttcttgatgcttgtaccgctcagaaatagactgaggttgtgtttgtttttgctcaaactttcctaaagaggaaacccgctccccaaagttgaccagatagatgtatcatctttccggatgtgaattatttcggctgtgtgctatgagaactgggtatggtgggaagtaattgtttttctggctctcatcaggtcctggttcctggttgcttttctttacccgagagggccacaaaagataccactctcctgagacttccaagttccccttcagcaagaccctcattcctctggggagagagggagagttggccatgttatattcgaaagagcctgggtattggaattggccatatttagtggtgagagcctgtgatacttatttaacctttctgggccttgtttcactcactacatttttttttttttttttttttgagacggagtctcgctctgtcaccgggctggagtgcaatggcgtgatctcagctcactgcagtctccacctcccgggttcaagcgattctcctgcctcagcctcctgagtagctgggactacaggcacctgtcaccccgcccagctaattttttgtatttttagtagagacagggtttcaccatgttggccagaatggtctcgatctcttgaccttgcgatccatccacctcggcctcccaaagtgctgggattacagctgtgagccaccccgcccggccttcactcacttcttaaaatggagacggtcaacagggttggtgctgaattaatgaagtaagatccagaaatcactagagctgtgatgggcacatagtcaccgcagcggtggagaactgaccatctgtcccttgtgttgtttaggcctcatctctgcatggtcctcattggctctgagttctagtgtgtagtgtccacagtgccaccctccatgagggttgtgttgactgtgaggtggtgcagagaatgtccctgtccttgtgagcatatgacagcaagacactggccctggaatcctccgtgtcacatgtgggctgctgacaggaagaatgtgcttttgttgttgttgttgttgttgaggcagagtcttactctgtcgcccaggctgcagtgcagtggcatgatcttggctcactgcaacctctacttcccgggttcaagtgattctcctgcctcagcctcctgagcagctgggactacagatgtgtaccaccatgcccgactaatttttgtatttttagtagagatggggtttcaccatgttggtcaggctggcctggaactcctggccttaagtgatccacctgtctcggcctcccatagtgctgggattataggtgtgtgccaccctgctgggccgagaatgtgcttttgactgagggtggaaagtcagcagctgcagcccaagaagttagagccaggggcagtgcctttgatgggaagcttgggggtctaaagaaatcagaaaggggagaaaataatcctgcgtgtgctcagccctcactcagatcaacagcccctcgggtcccagctagatgtactttgtagaaggctttttttctccccctcaccctcaaaactccaggattaatgtgctattcccttttttctactgttctctgtctccccccaacccatcagcagtctgagaaatgctatggtggaaaaaaaaaaacaacagccctataaccagtacaaacaaaaagccaagacaaaaaaaaaaaaaaaatcagaaggggagattttgaggccaggaagccatggcattcactggaaatatatcagtgataaaataacaggctacagggtttattttattttatttttaagtcaataggcctgagtgttggtaaagactagatacccagcagtccttcttgcatttcttcttggggtgggggggcagaagggaatggagaggaaatgaaggcggattgctggtaagtgaggcaggaaggcagggagtttattatggaatgtcatcggtaagtttccccatgatttgatcccaagctggtgtggagtgaagggtaagctgttggctcaacagatagtgagaatcaaacttagtggagttgtagagcctgtttcctgcagcggacagcaagatgtacaagccgtccactgcaggaatgacgtgctgtaaaagggatgcagtgtcaagtgtagtcatggatgggtgggaagaccagacaaaggcatccaatgggactgacttacctaaacaaaccagaaggaagtcagaacagtgggaagatctgatagataagcagtattctgcaggcagatgaaggagcaagctttgggcccccaaatcttcaccagtgcatccacattacagaggataatgcctgagggaggggaagatcatctcaggattctggaacactgggccctccctttcttattccaaaaggctggagcagttctgcatgtaggcttctctggaaatggtctaggaaccagctcatccaggccaggagcacctgatcattctcagagttacgtacatatgcgataagattgcagggaacagtatagttctatagacttaagtgtgaacatagtcctcatttatagtccctagtctcccatggctcacgcagcttggtctttatgtgtttctgaatttagtgctgcagaggcacaatggggtctggtttctggatcttatacagacaagcacttaggtcagctgcagtggatgtcctgcacagacaccgtcgcaactcttgcctggttcctttttgtttttggagatggagtctcgctctgtctcccaggctggagtgcagtggcgcgatctcagctcactgcaagctctgcctcccaggttcacgctattctcctgcctcagcctcccaagtagttgggactacaggcacccgccaccacgcccggctaattttttgtatttttagtagagacagggtttcaccgtgttagccagtatggtctcgatctcctgaactcgtgatccacctgcctcggcctcccaaagtgctgggattacaggtgtgagccaccacgcccggcctattgcctggttcttgaagggattctcaggaaccacagggaatgtctgagccagctttctggatccgtgtgtacagcccttcccagaggctttgtggagccagctgtacggtgcatgagctttgtggctaagatatcagagttctgcctggcccttggccttggtctctctcagatggtcagctgctctgtttttagtggttgatcatgtagaaggccaacaggtgttgaccttggtttaggctacttttgggatttttgaggtttcctgagactcttggttttctttcatcatcccgtccagaacctctgatgtcaaactaaattctgtttggaaaagggtatgctgtagaataatgatagccacagcaatgatattaataataccttttatcggttgcagcattttcttctttgcaaagcacctctaatgactttatctctcttgccctcacagccttccttgagtgggtacaggtccataatcccatatctgtgataatgaagtctgaaaagctctgaaaactaaaaagtttgcagtaaactcatttagtggcaaaacctgatctgaactgatgtgaggctatatttatcctgcttagtttgaatattcatatgttttgctgcaaaaatattaatgtgtttgattacagagtgctgccctagactctgctggggctgttaaacacgataggtgtcagagtacctttctttttttttttttttttttttttttgagacggagtctcgctctgtcgcccaggtcggactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggcccagagtacctttctaaagtctgaacagttttggtcgttgaagcacctgaaggttttggataagggattatgaacgattatcattctctattgacaaatgaggaaaatgagatttggagcaagtaagtgacttcccatggtcacacagctataaatgggtagaaccaggcactcagcttgccttctaattcacagtcctgggcgctctgcaccaggccatataagaacatgagcattgctcttctgggtcaaatccatctgacctagtctttggttgccatcaccatgcctaagataccaccattggaggctacaaccatcttccttgacgt

SEQ ID NO: 21 - DNA, 18012 bp, Artificial Sequence
  chemically treated genomic DNA (Homo sapiens)
gcggttttatagttgttttaggttttaagtagaggttaaagtattaaaaaaaattgaagaagatatatttaaatatataggtaagtataaaattttgttttaaatatttaatttaaaaaaaaaaattagaattttatttttttataggaaaggatagtttaaaatgagtatgtttaatttatagttttgaatgcggtttaatataaatttataaattgttttaaaatattatgagatttttttgtaattttttttttttaagtttattagttgtcgatagtgttattgtgttttttgttgttgttgttttgagatagagtttttttttgttgtttaggttggagtgtagtgttgtgattttagtttattgtagtttttattttttgggtttaagcgatttttttgttttaattttttgagtagttgggattataggcgtttattattatgtttgtttattgtttttttgtatttttagtagagacggggttttattatgttggttaggttgtttttgaatttttgattttaaatgattcgtttattttagttttttaaagtgttgggaatataggcgtgagttatcgtgttcgattagtgtattttatatgtggtttaagataatttttttagtgttgtttagggaagttaaaatattggatatttttggaaaatattgtatattttgaaattgaagttttaatcgattaggatatgttaagaatttagaaaaataaagtttttacgtatagttttttttaaattttttgttaattgggtaaaatggttgttagaggtgattgtgttttttttttgttttgttaatattatagaatttataaatttttttataaagagtatgatttagtttttttttttttgtaattatattttttagttgaaaaagtttttggttattatatttagttataaattagtaatagtgtgtatatgatttttgattatttttttttttgagttagaattagaaattggttttgtaatatttgtggattttgttttaattatatatttttttttatttgaaatatttagtatttttattgtttatatggtgaattttgagttttttaatttaatatataatattgaaatttttgttttgaaaaatttttaaatatttttgaagtttagttttgttattattttttttttgaaattttttttgattatttagttggaaacgatttaattttttattttttaatagtatatttttttgtattaaaattttttttgtaaatgttttagtttttttttagattataaattgttttatttattattgtattatttatatttatatattgaataaaaagtattaagtattgttatagatgcgagggaaagagtagtgtaggagaattttggtttttgtttttatgggatttatattttattttggaaaataatgatgagagagatagaaaattaaataaatatatagatagagttttttagattttaaatgtttagaatgtgaaattttattatgtggtagaaagtgtgaggatagtattagtgcgttgataaggtgattatggaaggtgtgatttttgaaaatttgatatttttgttaaaatttgaatgatatgaaggattagttatttgaagatttggaagtagaatttttgaggttgaacgaaaggtagttttaaggtataagaaagaggtaggtgaggaaggataggagaagtgataagaattagatttagattatgtagagttgtaaattaaggtaaagaatttaaaatttattttgattatattgggaagttaatgaatagtttgaagtttttaagggtttatgttattatattgggtttatttaggataattttatgattttaaggttagttaattaataaatttaattttatttgttaagttttttttattatataatgtagtatatttattagagtaatattagagggtaagtttttagggtttaaatgttgttatattttgtatgtataagttttatttaatttaatatatatttagtattttataagggtagtgaaatagaattaatttagggtagttgagttgttgagttattatagtttttttgatttattttgtttttattaatatgtttattttttggtattattttttatttgttaatgtttatacgataattttaaattttgtttttttttagttatttaattaaattaatataaagatgttttttgtatttaaagaaattttgttttagatattttttagagagatttgtatttttttatggataaaaatttatgggtggatttattgtagattttaaaaggatatttttaaatttgtttgagtttttttatttttatttattttgattataataaatttatttatttaataaatatttattaagtatttattgttgtagagttagttattatatagtaagtattagaatgataatagttgaataagtaattttttatgagggatgaggtttgaaaaagtataagttgttttgaaaggtattttagtgaaggaaattgttgttgagatatggaggatgaggtaatatagttagtattggttttgaaggcggattgttattttattgttgggtgaatttggatattttttaaaatttttttgagttttaattttttatgtatgtgaatagtgatatttttatttttatagaagttttgttagattgaatatatgaaaatgtttaacgtaatgtttgttattggtttagaagtatatttattatgaaattgatgaagtttagtgaatttaattgtatggttttttttaaggtttttgtaggagtagttttagtaattttgaattaatttgtgttttttttaaggatttttttatttagttgtttttttattataggttgttggttattataaaatttgaatttgtttttggttataggttaagtgagaaatgttaattttttttttttttaatgttgtgattttagttagtgtcgaatttagaagtatttaatttaaaaaaaatggaaagaaattatatatattaggttgtaggaattttataaaatttagaaaaatcgaaatttttgtaatttttagggaggaaatatgatgttttatttttttttgtttttttttgtgtatatacgtaatttattttttaaaagttagtttatattatattaaatagataatattttgtatttttatataatatatggattatataattatatattatataattatattttataacgtaattttaattattttataaatgtgttaaaagtataattaattaagttgttgttagtaattgttgaggttttttttaatattttagtagtataagtaatgttaaattataaatttttgtaggggtatttgtatataggataattttttttaattgggtttgtttgagtataagaattgtttttgtttattttttgttattataataaaatatttgagattgggtaatttataatgaatagaaatttattggtttatagttataggagttgagacgtttaagagtatggtattagtatttggtgagggtttttttattgtgttattttaaggtggaaggaggaaggataggagacggttagagtaagtaagggattaaatttgtagttttaggttttttaataaaatatattaatttattattgagggtggaacgtgaatattttttattaggttgtagtttttaatattgttgtattggggattaaattttcgatataggtttttgggggatatatttaaatcgtggtaaatattttaaagatttatatgtttttattgattttataatattattttaaaatattattgtttatttttatagtatttttgtgtttatttttatttttttgattatttgatatattaaaatatttttttgggtttttttggttttgttttgttttgttttagatagagttttgttttgttgtttaggttgtagtgtagtggcgtgatttttgtttattgtagtttttgtttttcgggtttaagtgatttttgtgttttagtatttcgagtatttgggattataggtatgtgttatttcgtttggttaagttttgtatttttagtagagatagggtttcgttatgttggttaggttggttttaaatttttggttttaagtgatttgtttattttggttttttaaagtgttggggttataggtatgagttattgtatatgattagaatatttttttatgtatttattagttttttatatttttttttatgttaattgttagtatttatgtaagatatcgggaaagttttttgataggaagaagtaagttttttttttttgtaagtaagttttgaggttgtataatattttaaattaaaaggttattttaaaatggtttttttattgtagtgtagtgggaatttcgagagtagaatttaaaggagtgtttggtgttttttatttttggtagtatatattaaagtttgggtattatttatagatttttttttggtgttttaaaagtttttcggagtattaaagggattttgtagtgtaataattaagtttagaaatttagtttcgtggttgtattataatatttgtttttttatatataggggttagagttttaatttagaatatttcgtttttttagtagaaggttatattttataataatattatttaataattgttttattattatttcgtgagggtattttaattgaatgttttttgcgggttaatttaaaattattttttaaaataatgtttaatgaatatttatgtagaaaatattgtgatatatattatgagatatgagataaaattaggtgagggttttttttttgggattttaatagttaggaatgggataagaggtgtatatatataggtataaaatgtgtttgtgttataaaagatgtaggaataatgaagggaaaaggagatgaattgattttaggtgggttgttggattattttatgggaatttatgtttaagttaaattatgatttgggttagtagagtaattaattattttttattttaaaaaattgttttagtttataaagtttgtttataatatataatgatttttattatagttttgtaagataagttagttatttttattttatagatgaaggagtagttaagttttagaaaagttaaatgatttttttagcgttattaagttataaagtgaaagatttagaatttgaatttaagtttttaatttttatatgttggagttttttaaagtattttagtagagtagcgaagagttatatgagtaagaaattataagttttagaaagggttgatagttaattttattattaggatggaagttttgaaatagttggagataaagttatagtatggttagtagaataatggttttttataaatgtttgttttttagtttttagaatttatgaatatgttaggttatgtgataaaagggaattaaaatggttaatgaggtaattttaaaataggaagattattttggattattgacgtgggttaaatgtaagggtttttaaagaggttatttaagagtggaagagggaggtagaaaaatgagagttagagaaggagatttgagaaggggtaaggttagttttgtagaatgagaaagatttagtttattattgtttgttttgaagatggaagtgaagtgttatgaattataaaatatagtggatttgtagaagttagaaaggataaggaaatagatttttttttagagtttttagaaagaagtgtagttttgtagatattttggttttagtttagtgagatttattttagatttttgatttataaaattgtaagttattaaatgtgtgttttaagatattaaatttgtggtaatttgttttggtagttataggatatttaatacgtttaggaattattttattgtaggaagattaattaatatgattttagggtattttatgattaaattttaaattgtttttgttttattgttagtagtagaaagatatggaatgtttttgagtaaaagtgtgaagaattattttggtgtttgttgattagagaggatattggtgagaggaaaattaattaagattttattagatgttaggaatattttttttgagatttattttttgaggtaatatagaatatattggtaagttttgttcgtagaagattatgaatatattttttagttttgtgtggttgtttacgtttgtaattatagtattttgcgaggttaaggtaggaggattatttgaggttaggagttcgaggttatagggagttgtgtttatgttattgtattttagtttgggtgatagagtaagatttcgtttttgaaaaaatgggagatggttaggtggatggatagatagatagatatatagataaagatagatacgtgggttaagattttttatttagtttatatattattgaaaattttattgttattgtaatattttatttcgttttcgtattttatgaaaaatatagaattagttaggtatatatttaatttatttttttttaggtttttttatcgtattataattaattataagattcgaatattgaaaggtttttaaatttgagttttatttgatgttttagtatttgtagaagttaaatttatattagtaattgtttttttaatgtataattattattttgaaagaaaaaaaaagtttgttgatatttgtaggtataattttattttatgtttaaggttttcggtaaagagagacgattaagtttattagtaaagtattagagttaattaaggcgattgaaaggagtattaattttaatttattttatattagttaatattgttaatattttttttgttagttttttaaattaaaagttttaaattaggttaaaagtgtttaggtaaaaatggaatggaaagggtttttttgtgtgtgtgtgtgtgtttttttttttttttgagatagagttttgttttgttattgaggttggagtatagtggtgtgatttcggtttattgtagtttttattttttaggtttaagagatttttatgttttagttttttaagtagttggggaatgtaatatttaagatattaagaattttattaattttatttagttatttttttttgtagttgtagaaggtttagaagggttttttaagttgaattatatgtttatatttataatatttatatatgaaattatttattaaaagtaatgaagttggttataataaatattgatattgaaaataagagatatgtttgttagtgcggtttttaaatagtgttatataatttatttttgttttattttgattagaaaaaatatatatattttttgagatatggtttttgttgtataggttggagtataatggcgagatttcggtttattgtaatttttgttttttgggtttaagtgatttttttattttagtttttagagtagttaggattataggcgcgtgttattatagttggttaatttttttgtatttttggtagaaatgaggtttcgttatgttgtttatgttggtttttaatttttgagtttaagtgaattggttatttcggttttttaaatttttgggattataggtatgagttattgtattttgtttagaaaatatttttaatgtatatatatatatatatatatatgtatatgtagtgtaaataatatttttaattaaatagagatggtaggagttttattttgagttatgtgtaaatttgataagataaggtaatgttttagtaattttttatgttgaaatttggtttagtatattttgattatatatttatatttaattatagttttaaaatagttaagtagttttaaaaatttaaattaaatttttgtggaatttttaaaaataagaaaaatattattgagtaattggtaatataaaatataaaatgtttaatttggtttttttttagatttgaagtatagtgattaatgaatatataatggtcgtagttttttttataattatgttatttaagttattgatgaatatttatgatatatgtagtaaaaatttagataaatattttggttataaattggtttattaaataatagtttgtattatagtttgagttaagagtaataggtttataattgtgttttagggtattaagaagtttttttgaggattttttaaaaggtattttttgttttgaaagattgttttttttttggaagttttaggttttatgagaaattatttattttgaatttgttataaaaaatgatttgtaaataagttttgtgtagtgaattatgtgtttttagtaagaggattttgaaagttttttgtaaaatgaagttatttttaaaagagagttatttagaatataattaaattgatttatatgtttttatttattttaaatatgaagggaaattgtttttaaatatatttaaatttttaatagaatagtagtatgttattagtgtggaaataatttatttgttaaataaatatttggggtgtatttgttgtatattaggtattgtaatatagggattaatgaaagagaaaaaaaataaagtacgaaaggatagtagaaatagttttataattttattttttaggaataatttttatggatattttgttgtgtgtttattgtttttttaatatatatattttttaattaaatggaattgttttaaatatgttatttaatagtttgtttttttttatattatttgaaaattaagaaacgattataatatgttttatttaaaaattttaagtttaggtcgggtatagtggtttacgtatgtaattttagtatttggagggatcgaggtgggcggattataaggttaggagattgagattattttggttagtatggtgaaatttcgtttttattaaaaatataaaatttagttgggtatgatggtacgtgtttgtagttttagttatttgggaggttgaggtaggagaatcgtttgaattcgggaggtggaggttgtagtgagcggagattgtattattgtattcgtttggtgatagagtaagattttattttaaaaaataaataaagaaaatttgaagtatagtatttttttaaattttaaatagataatagaaattggtttttttttatttaaattagaatttaagtttaattttatatatttttgatagtttggattttgttttttaattttataaaattgggaatttaagtattatttggttcgatttaaatgtaatgtagaatttgtattaaaatattatattaaagttttagatttgtagtagttaatagtatttttatgtatgtgttagggattgttttaaatattttatatatattaatttttttattttgtatttttgttttcgttttatatagtaggaaattgaaatattgagaggttaagtaattaaagttatagagttagagtgataggagtaaagttttaatttaggtaatttagatttttagagttttgatttttattattaagttgttagtatagtttttttggtaattatttttaatttaaatataattcgagtgatttatttaataagttattattttgataatttagtgatttgtaatgtaaaattatttattgtaatttatttaatattattgtttttttgtgttgtaaaaattatagtaatcgagatgtaatttattatttttttttttattttcggtattttgtgttaatttttttgttttgcggatttttttcgattttttattatgcgtgttaattgttattaatttttttgtttgttggggattggggtcgcgagggtatattttcgaggggtacggggttagggttaggtaggttgtgcggttgggcggggttttgtgttttattgcggagtgcgggtcgggaagcggagagagaagtagttgtgtaattcgttggatgcggattagggcgttttttattttcgtcgggagttcgtcgattggttgggtgtgggcgtacgtgatcgatatgtggttgtattggtgtagttcgttagggtgttattggagatagaatggaggtgttgtcggattcggaaatggggtaggtgttggagttattatggttaggtttgttgcggggggaggggggaaggtggttttttttcgtattgttttaaatcgatggtttttttttggtatagggtttattgtagtatgttaaacgaggaggtaggggcgtcgttttttcgttttttattgtagtattggagatggattttttgtatttcggatttagggtttttgatagaagaggaagaagggggaggggtagaagtgttaaggggagtttgttgagaaaagttgtttttgaagttagaaggggtttttgtttttataatgttatttgatagagtggaataatagtatttaaggaaacgggtagaggataataaagaatggagtatatttatggcgaggagtaaaagttttattttattgaaaggtttttttttttttttggcgataaggatatatgtattggtggttaaaagagagaggagataaaatcgttgtagatggttgatgtgaatttagtggaaagagttattggggatgagagaaagaggaggaggtaggtattgtagagcgtgagtggtggtgttggttggtgaaatattggttattagtagtgtgtttgtttttgtaaaatatttaagtaaattttttgtgaatagggtggtaaatagatattagtgtttttgttagttataaaatgtagtggtagtggttttttgcggacgattgtagtagtgttttttttttttttgttaggtcgaaaagataattgtagaggaataagaaattttgtagtaaatgttggggtagaagtttatttataagaagttatagtttataaatgtagtttgaatagtagaaaaaaaattattgttttttaaagtaggaataatgttaggttatgaatgttttgttattggaatgtattggatattttgattttatattacgaaagtgatgtttaaattttttgatttaatataaattttatacgaaattttaataaattatgtatgaaatagtggatttttttttttgttagtgaagtttttatgttattaattaggttatttaagagtaaattattttataacgtaaattattttgttaaaaattatggtgaataaatttttgtaggtttaatatttaagatttatagttaagtaattttatatttttttttggttgtttttagataatattgaataaatatttaagatattaatttagtgtgtaaatattttaaattaaagtaatatggttttttttttagatgtatttttgtttagtgagtatttatgagatatatttttgatataaagtgttttttattgagttttttttttttttatttaaatgtaaaagtttatttttatgtatatttatagtagttagtttgttatatttttttattttttgaataaggatggtagtggttttgtaaagttttttagggttagtgatagtgttttttaaataatgtttatgtaatagaaagttttaagatgatttattatattgttttagtaatatttttaagataatgcggaattgggttggtttagataaataagattatataagttttttattgataaatttaaatagttttttaaaaaattatttttgttttaagaattatttgattatggatattagggttaatagtatttaggagtcgggcgtggtggtttatgtttgtaatataagttaaataggaggttgagggaagttgaggtaggaggattatttgagttttggcgtttaagattagtttgggtaattaagtaagattttattttaaaaaaaagtatttagagttttttttttaaaatttgatggaaattatggttagaattaaagatgttatattaaaattttaaatgatatttaatagttaatattatttagttttttgaattttattagtatagtgtttgagagtttataaaattattatttttatataaattattttttattattttaatagtttattgtagtattatttttattttaaatgttagagatttttatttaagtatgttgtgattttatttaaggttaaatattgtataataatgtaaagaatttaagttttttattttattttaattttataaaattataatgttttttattatatatatataaaataatatataatagaggtaatttgaaaaatagtgtaagttattgataaattatttaaaaaatgaaaaggtaattttatttggttgtggatttttatttataatataagaatgttttaaaaaatatttggtgattaagtaaatggagaagtagtagtttttataatgatatttataaacgattttttaaagatcgttttattaattatatgaatatatttaagtagaatagtgttagattgagatgtttttttgaattaaataagaaataaagaattaaagtttattttattttttttgtagtatatttaatttatgattgatttattggttttagtggtttttgaaattatttattgttttgatatggtttgaattgtgttgtttaaggaatttaaaattaaatatttataaatgttttatgaattgaatttaagttattgaagtttttgttttttgtgtttttttttttttttttttttttttttttgagatagggttttattttgttaatttaggttggcgtgtagtagtaaatatggtttatttgtagttttaatttcgtaggtttaagtgatgtttttattttagttttttaggtagtagggattataggtatatattatcgtgtatagttaatttttatattttttgtagagatggggttttattatgttgtttagggtggtttcgaattcgtgagtttaaatgatttttttattttagttttttaaagtgttgggatttataggtgtgagttattatgaagtttttttatttgtattaattgttttgtagattttattatttttgtttgttttataaattgttatttattttatgaaatttaattaattttttatatttgtatatgtttaaatgattttttatatttgtatatgtttaaatgttttttttaattttgattttttttttttttttttttttgtattagaatttgaaatttatttatgtagtatataaaatgggatagagtattatggtttagaaaagatgggtaatagtttaggaaatatatttattatatatttattaggatattttttaaatattatttttgaaaaatgttggagttaaataagatacgtaaattaatttttaagaaaatttatggtagaattatgtgaaattttattataagttaaatattgttttggttatttttaggatatttaaagatttatataatttaagatattttttaatttagaagaatatggtggattgttgtttgaaatattgtttttttataaaatttgtttagagttatagagaatttttgaaaattaaattatttttgaagtattaagtattttgaatgtataatgagaatattaggtgaataggtatgtttttaaaagttgattttgtaaattaaattatatattattagttgatataaggtaagtttttttttttttatttttatattttgtatttattttttttgtgtgtttaatatgtataaatttttgagaaatagtattattttgtgagtttgttttttatagttaatgagatttttaaaaaaattttattgtgataaatatatataaaatttattattttaagtatttttaattgtatagttttgtggtattaagtttatttatattgttgtgtaattattattattatttatttttagaaatttttaattttttttaattaaaattttgtgtatattaaatattaatatgttatttttttttttttttaatttttggtaattattattttattttttgttttaaagaatttgattattttgggaatttttaataagaaaaattatttaatatttatttttttgtatttggtttattttatttagtataatgtttcgaaggtttatttatattgtagttatgtgttagaattttttttttttttaggtttaaatgatgttttattgtatgtatatgttatattttgtttatttatttgttagtggatattttaggttgtttttattttttgtttattatgaataatgttattatgaacgtgggtgtgtaagtgtttgtttgggttttattttttttgtgtgtatttaaatttgtgtttttaatttatataatttttgaatattattaatttaatattgtttttaagatttatttattttattttatgtttatttagtttgtgatgttaattttgttttatagtattttatagtatttattattgtttttttagtgaaggtcgtaagttttttttaaatttcgttaattataaatatttttatgatatatatttttatatatatttttttggattatgttatttatgtatttttgtataataaattgtattaaaatttagtggtttaaatagtttttgtggggtaagaatttaggaatgttttagttggatggtttgattgaggtaggattttttatgaagtagtagttacgatgttagttatagatatagttatttgaagggtttgattagattgacggatttttttttaagatggttaatttatatagttttagttttttattggttattggtaagagattttagttttttgttacgtgggtttttttatggggttgtttgaatgtttttatgatatagtagttggttttttttaatgattttaatagaaaggttatttatgatttagatttagaagttatatattattgtttttgttgtattttttttattagatatgagttattaagtttagtttattaaagagaggaattaggatttattttttaaaggagtagggttaaagaatttatgatatattttaagattattatatcgattagtgaaatagttttattggatttatttttaggagagggattattggataataagggtattgttttttattgttgttgtaataaattaatataaatttagtggtttaagagaatataaatgtattattttgtagttttggagattagatacggtttttattggattaaaattaagatattagtggttttgcgttttttttagagattttattgaagaatttatttttttgtttttttttagttttttgtattttttgttttatggtttttttttttatttttagtgttagtagtattttaaatttttttttgaatttgattttttgttgtttttgttatatatttttttttgatttttttgttttttttttaaaagaatttttgtgattatattgggtttatttagataatttaggaaaattagttttaagatttttaatttaattatatttgtaaagtttttttagttatataaggtaatatatttataagttttggggattaggatttggttatttttgtggggttatatataggtatatttatttggttttttattttttttaagttgaaggatttttttagttatttttatttttgcgaatgtgtgttatttttttttggtaattttagatttttatttattaagtttatttaaagtatagtataatatataatgattattaagatggtaagtagatatttattgtttaattagatttttgattttattattatttaatttatattagtgtattagttatttttgatatagtttgtaatagaaattgagaaacgttaaagtaatatagttttattaaatttttttttgtattttttagattcgttataatattagttttgtgggcgttttgttgaaatttgatttgttattgttttattagttattgaatttagggttattttaatttagtatgattttattttaaatttgatttatttatgaagattttgtttttaaataaggttatatttgatatgatattttttggtgtttttttgtttgttggtttttttttttttgttgcgtaggttagagtagtttttgggtttaagtagtttttttaattgagttttttaagtagttaggattataaatatgtgttattatagttgattaatttttaattttttttttataaggagagagttttattatattgtataggttggtttcgaatttttgtttataagtgatttttttattttagttttttagagtgttgggattataggtgtgagttattgtgtttatatttgtaatatatttttttatgaaatatagtttaatttataatatttttttaatatttggtattttgtgaataataagatatttaaatatggtattttgtggataataaggtatattgttttattttttttatggaaaagttattttggatattttttgaatttgtgttttttttttttgttgtttgttttttgtggttgataatgtattttttttgtttatttttacgtgtatatttgttttttatatggttgtcgttgagtaaagtattttgggaattataaaagttaagtattagatatagattttgtttttaagatatttatgttttagttgggaagataaaatattttaaggtaaaatggaataatttgagaagttaggttaaattgtatagtatttattgtttagttagtaggaagatttattattggttagagatattaggaaggttttgtgtaagaaattgagttgggttttaaaggatgaggatatattataatagtagaggaaaaaaggatgtggtatttagaaaggggaggaggtataaataaaaatataaaggtaagaaatagtttgtagaggaaagtgaggagagatttatttgaggaaggttattttggaatttaataggaaataagttttgaaggtagattattattagatataatagattgtgaatattagatagaagttatatagtttttgagagtatgagtattaaaaataagtatagatttgaattttggtataggtttttgatatgtgtttttagggaagttatttattgttttggagttttattttttttaatttaaaaatgagtaatatttattttataggtggttgtgaggattaaatgagttaatatatagaaagtatttatattacgtgagatattgtaagtattaaatagatattaggttttttgaattttatatattaaatatataaaaaataagggtatatataggatttaaataatatgttggttagttatagaattttatatatttttttttttaaaatatttttagtaaaatttttatgaaaattagttaaggtaaatttttaaaaatttttagatggtaataattttataagtaatagttttttattaatttaataagtaatgtattaatgataataaaaagatgatttaaaaagttttatatatttaataattgagatagatttttgaagtattttttagattaaagaggaaattaagatggaagttatgagttatttggaaataaagaggggaatattttatattaaaatttgtggaatgtagataaggttgtattaagagaaaaattgatgtttttaaaatttatattattaaggatgaaacgaataagtgaatgtttaagtaaagtaaggaaataaatgaattaatatttattttattattattattattattattattattttttgagacggagttttattttgtcgtcgaggttggagtgtagtgttgtaatttcggtttatagtaatttttattttaagcgatttttttgttttagcgatttttttattttatattatagttgggattataggcgggtgttattacgtttagttaatttttgtattgttagtagagataggattttattatgttggttaggttggttttaaatttttgattttgatttgtttcgtaaagtatggggattatacgcgtgagttattacgt

SEQ ID NO: 22 - DNA, 18012 bp, Artificial Sequence
  chemically treated genomic DNA (Homo sapiens)
gcgtggtggtttacgcgtgtaatttttatattttgcgaggtaggttaaggttaggagtttgagattagtttggttaatatggtgaaattttgtttttattaataatataaaaattagttgggcgtggtggtattcgtttgtagttttagttatggtgtggggtgggggggtcgttaagataggagaatcgtttgaggtggaggttgttgtgagtcgagattgtaatattgtattttagtttcggcgatagagtgagatttcgttttaaaaaataataataataataataataataataaagtgaatattaatttatttatttttttattttatttaaatatttatttattcgttttatttttaataatataaattttaaggatattaattttttttttagtatagttttatttatattttataagttttagtatgaagtgtttttttttttatttttagataatttatgatttttattttgattttttttttgatttaggggatattttaaagatttgttttaattgttaggtatataaggttttttgagttatttttttattgttattgatatattgtttattagattaatggaagattattgtttataaaattgttattatttgaaaatttttaaaggtttgttttgattaatttttataaaaattttattaaaaatgttttaaaaggaaaagtatataaagttttataattgattagtatattatttaaattttatatatgtttttattttttatgtatttgatatgtgaaatttagaaagtttgatatttatttagtatttataatattttacgtaatgtaaatgttttttatatattaatttatttaatttttataattatttatgaggtaggtgttatttatttttgagttaagaaaaatggaattttaaaatagtagataatttttttaagaatatatattaagagtttatgttagaatttaaatttgtatttgtttttaatgtttatgtttttaaagattgtataatttttgtttggtgtttataatttattatatttgataatagtttatttttaaaatttattttttattaagttttaagataattttttttaagtaagtttttttttatttttttttataaattattttttatttttatatttttgtttatatttttttttttttttgaatattatattttttttttttttgttgttataatatatttttattttttaaggtttagtttagttttttatataaaatttttttgatgtttttagttaataatgaatttttttgttggttgaatagtaaatattatataatttggtttaattttttaaattattttattttattttggggtgttttgtttttttagttggagtataaatattttgaagataaggtttatatttaatatttagtttttgtaatttttaaaatgttttatttagcgatagttatataaaagataaatatatacgtaagaatgaatagaaagggtgtattattagttatagagggtagataatagaaagagagggtataagtttagagaatgtttaagatgatttttttataaaaaaagtaagataatatgttttgttatttataaggtattatatttaggtattttattatttataaggtattaagtattaagggagtgttatgggttgaattgtgttttataaaaagatatgttataggtgtgagtatagtggtttatatttgtaattttagtattttgggaggttgaggtgggaggattatttgtagataggagttcgagattagtttgtgtaatatagtgagattttttttttatgaaaaaaaaattaaaaattagttagttgtggtggtatatgtttgtaattttagttatttgggaggtttagttgggaggattgtttgagtttagaagttattttagtttgcgtaatagagggaaaaaaattaataaataaaaaaatattaaaaaatgttatgttaaatgtgattttatttgaggatagagtttttataaatggattaagtttgagatgaggttatattggattagagtggttttaagtttaatgattggtaagataatgatagattaagttttaataaagcgtttatagaattggtgttataacgagtttaaaagatataaagagaaatttaataaggttgtgttgttttaacgttttttagtttttattatagattatgttagaagtagttgatatattgatataaattaagtgatgataaaattaagaatttaattgaataatgaatatttgtttattattttggtgattattatatattatattatgttttaaataaatttggtaaatgaaaatttgaaattattaaaagaaagtaatatatattcgtaaaagtaaaaataattaaaaaaattttttagtttaaaaaaaatggagaattagatgagtatgtttgtgtatggttttataaagatggttaaattttagtttttaaaatttatgaatgtgttattttatgtggttaaaggaattttgtagatgtgattaagttaaagattttgaagttgatttttttggattatttgggtggatttaatgtaattataaaggtttttttaagaaggaggtagaagggttagagaagaatatgtgataagagtagtagagggttagatttagagagagatttagaatgttgttggtattgaagatggagaaagaggttatgagataaggaatgtaagaagttgaagaaaagtaagaaaatggattttttaatagaatttttagaggagacgtagagttattgatattttgattttggtttagtgaaaatcgtgtttgatttttaggattgtaagataatatatttgtgtttttttaaattattaagtttgtgttaatttgttataatagtaataggaaataatgtttttattatttagtgattttttttttagggataaatttagtgaaattgttttattggtcgatgtaatgattttaaaatatattataaattttttgattttatttttttaagaggtggattttaatttttttttttggtgggttggatttagtgatttatatttaataaagagaatatagtagaagtaatggtgtgtggtttttgagtttaggttataaatggtttttttgttagaattattgagggaagttagttgttatgttatgaagatatttaagtagttttatggagaggtttacgtgataaggaattgaggttttttgttaatagttaatgaaaaattgagattatgtgagttagttattttggaagaagattcgttagtttagttaagttttttagatgattgtatttgtgattgatatcgtgattgttattttataagagattttgttttagttagattatttaattaagatatttttgaatttttgttttatagaaattgtttaagttattaagttttggtataatttgttatatagaaatatataaataatatagtttaaggagatatgtataagaatgtatattataaaggtgtttgtggttaacgggatttggagaaaatttacggtttttattggaggaatagtgataggtattatagaatattatagagtagagttagtattataaattagatggatataaagtaaaatggatagattttaaaaatagtattgagttaataatgtttaaaaattatgtaaattaaaaatataggtttgagtatatataaaaaaagtaaaatttaagtagatatttgtatatttacgtttatagtagtattatttatgatagataaaaggtggaaataatttgaagtgtttattgatagatgaatgaataaaatgtggtatatatatgtaatggaatattatttagatttaaaaaggaaagaaattttgatatatggttatagtatggatgaattttcgagatattatgttaagtgaaataagttaggtgtaaaagaataaatattaaatggttttttttattagaggtttttagaatagttaaattttttgagataaaaagtggagtggtggttgttaagggttggggggaggggaaaatggtatgttagtgtttaatgtgtatagagttttaattagggaagattaaaaatttttagagatgggtggtggtgatggttgtataataatgtgaatgaatttaatgttatagaattgtataattaaaagtgtttaagatggtaaattttatgtatatttattataataaaatttttttaaaaattttattaattgtaaaaaatagatttataaaatgatgttattttttaagaatttatgtatattaaatatataagaagagtgggtgtagggtgtgagaataaaggggagaaggtttattttgtattaattgatgatgtatgatttgatttataaagttaatttttgagaatatatttatttatttaatgtttttattgtatatttaagatatttagtattttaaaagtaatttagtttttaaaaattttttgtgattttaagtagattttatgaaaaagtagtgttttaaatagtaatttattatatttttttaaattagaggatattttagattatataaatttttaaatattttaggagtagttaaagtagtgtttaatttgtaatgaaattttatataattttattatgagtttttttagagattagtttacgtgttttatttgattttagtattttttaaagatgatatttagaaggtattttaataaatatgtagtgaatatattttttaaattattatttattttttttgaattataatattttattttattttatgtgttgtataggtaggttttagattttaatataagaaaagggggagaagggagattaaaattgaagagaatatttaaatatatataagtataaaagattatttaaatatatataagtataaaagattggttaaattttataaaatgagtaatagtttataaaatagataaaaatggtaaaatttatagagtaattaatgtaaatggaaaaattttatggtggtttatatttgtaaattttagtattttgggaggttgaggtgggaggattatttgagtttacgagttcgagattattttgggtaatatggtgaaattttatttttataaaaaatataaaaattagttgtgtacggtggtatgtgtttgtagtttttgttatttggagggttgaagtgggagtattatttgagtttgcgaggttgaagttgtaagtgagttatgtttgttattgtacgttagtttgggttgataaagtgagattttgttttaaaaaaaaaaaaaaaaaaagaaaaaaaaatataaaaaataaaaattttaatagtttaaatttagtttataaaatatttatgaatatttaattttaaattttttaaatagtataatttaggttatattagagtagtgaataattttaaagattattaaagttaataggttagttatagattagatatattataagaggaatgaaataaattttagttttttattttttatttaatttagaaaaatattttaatttaatattgttttatttaaatgtgtttatatgattaataagacgatttttaaaaagtcgtttatgaatgttattatgaaaattgttgtttttttatttgtttagttattaggtattttttaaagtatttttatattgtagataaaaatttataattaagtaggattgtttttttattttttgaataatttgttagtgatttatattgttttttaaattatttttgttatatattattttgtatgtatgtaataaaaggtattatagttttatagaattagaataaaatagaagatttaagttttttatattgttatataatatttgattttggataaagttataatatatttgaataggagtttttaatatttaaaataaaaataatgttataatgagttgttaaaatggtaaaaggtaatttatgtaaaaataatagttttatagatttttaaatattatgttaatggaatttaaagaattgagtaatattagttgttaaatgttatttggaattttaatgtgatatttttagttttagttatagtttttattagattttaaaaaagagattttaagtatttttttttgagatagggttttgtttggttgtttaggttggttttgaacgttaaggtttaagtgatttttttgttttagttttttttagttttttgtttagtttgtattataggtatgggttattacgttcggtttttaagtattattaattttgatatttatgattaagtaatttttaaagtagaaataattttttaaagaattatttaaatttattagtgaaaaatttatgtagttttatttatttaagttagtttaatttcgtattattttgaaaatattattgaaataatataataggttattttaagattttttattatataaatattatttaagagatattgttattgattttggagggttttataaagttattgttatttttgtttagggagtggggaggtgtggtaggttggttattataagtatgtataaagataggtttttatatttaggtaaaggaaaaaaaagtttaatgaaaaatattttatattaagagtatattttatgagtatttattaaatagaaatatatttagaagaaaagttatgttgttttaatttaaaatatttgtatattgaattaatattttaaatatttatttagtgttatttaaaagtaattaaagagaaatataaaattatttaattataggttttaaatattaggtttataaaaatttgtttattataatttttgataaagtaatttacgttgtaaagtggtttgtttttgaatgatttaattaatggtataaaagttttattaataaaagaaaagatttattgttttatatataatttattaagatttcgtataggatttatgttaaattaaagaatttgagtattattttcgtgatgtagaattaaagtgtttaatatattttaatgataaaatatttatagtttgatattatttttattttaaaaaatagtaattttttttttgttgtttaggttgtatttataaattatggttttttgtaaatgggtttttattttagtatttgttgtaaggttttttatttttttgtagttgttttttcggtttaatagagggagaaaaagtattgttgtagtcgttcgtaaaaagttattattattgtattttgtaattaataaagatattggtatttgtttgttattttgtttatagggagtttatttagatgttttataaaagtaggtatattattggtgattagtattttattaattaatattattatttacgttttgtagtatttgttttttttttttttttttatttttagtagttttttttattagatttatattagttatttgtagcggttttgtttttttttttttttggttattaatgtatgtgtttttgtcgttagggaggaaaagaagttttttaatggggtagagtttttgtttttcgttatgaatatgttttattttttgttgttttttattcgtttttttagatattgttattttattttgttaaatggtattataaaaataaaaattttttttggttttaaaaatagttttttttagtagattttttttaatatttttatttttttttttttttttttttttgttaaaaattttggattcgaagtataggaaatttatttttagtgttgtagtggggggcggggggacgacgtttttgttttttcgtttggtatgttgtagtggattttgtgttaaggaaaggttatcggtttaagatagtgcgagggaaaattattttttttttttttttcgtagtaagtttggttatggtggttttagtatttattttattttcgagttcggtagtatttttattttgtttttagtgatattttggcgggttgtattaatatagttatatgtcggttacgtgcgtttatatttagttaatcggcgggttttcgacgggaatggggagcgttttggttcgtatttagcggattatatagttgttttttttttcgtttttcgattcgtatttcgtagtggggtatagggtttcgtttaatcgtatagtttgtttagttttagtttcgtatttttcgggggtatgttttcgcggttttagtttttagtaagtaaggaagttgatggtagttgatacgtatagtaaagagtcgggggaggttcgtagggtagaaggattagtataagatgtcggaggtgggagggagagtaataaattatatttcgattgttatgatttttgtagtatagagaaataataatattaaatgaattataatgaataattttatattataagttattgagttgttagagtgatgatttgttagatagattattcgaattatatttgaattaaaaatagttattagaaaagttatgttagtagtttagtagtggagattagaattttggaagtttgggttgtttgagttgaagttttatttttgttattttagttttgtaattttagttatttaattttttagtgttttaattttttgttgtataaaacgggaatagaagtatagaatagaggagttaatatatatgaagtatttagagtagtttttgatatatatatagaagtgttgttagttattataaatttgaggttttaatgtagtattttaatgtaaattttatattgtatttaaatcgaattaggtgatgtttaaatttttaattttatgaggttgaaggataaaatttaaattgttaagaatatataaagttaaatttaaattttggtttaaatggggggaaattagtttttattatttatttaaaatttaaaaggatattatattttaagttttttttgtttgttttttgagatagagttttgttttgttattaggcgagtgtagtggtgtaattttcgtttattgtaatttttatttttcgggtttaagcgatttttttgttttagttttttaagtagttgggattataggtacgtgttattatgtttagttaagttttgtatttttagtagagacggggttttattatgttggttaggatggttttaattttttgattttgtgattcgtttatttcggtttttttaagtattgggattatatgcgtgagttattgtgttcggtttaaatttaaagtttttaaatgaagtatattataatcgttttttaatttttaaatagtatgaaaagaagtaagttattaaatagtatatttgaggtaattttatttgattaaaaaatgtatatattagaaaagtaatagatatataataaaatgtttatagaggttatttttggaaagtgagattatggagttatttttgttgttttttcgtgttttgtttttttttttttttattagtttttgtgttataatgtttgatatatagtaaatatattttaaatatttatttaataagtgagttatttttatattgatggtatattattgttttattaaaagtttaaatatatttagaaataatttttttttatatttgaaataaataaaagtatgtaaattaatttgattatattttaaataatttttttttgagaatgattttattttataaaaggtttttaaaatttttttattgaaagtatatgatttattgtataggatttatttataagttattttttgtgataaatttagaataggtaattttttataaggtttagaatttttagaaggaaaatagttttttaaaataaagaatattttttaaaaggtttttaaaagaattttttagtattttaagatataattgtaagtttattatttttgatttagattatgatataagttattatttagtaaattagtttgtagttaaaatgtttgtttaaatttttattgtatgtattatagatatttattagtgatttaaatgatatagttgtaaagaaagttacgattattatatgtttattagttattatgttttaaatttaaaagaaagttaagttaaatattttgtattttatgttgttaattatttagtaatattttttttatttttagagattttataaaagtttaatttgaatttttaaaattgtttagttattttaaaattataattaaatatagatatataattaaagtatattgggttaaattttagtatggaaaattattgaagtattattttgttttattaagtttgtatatagtttagaataaagtttttgttatttttatttgattgaagatgttatttatattatatatatatatatatatatatatatgtatgtattaaaaatattttttgggtagggtgtagtggtttatgtttataattttaggaatttgggaggtcgaggtggttagtttatttgagtttaggagttggagattagtatgggtaatatggcgaaattttatttttattaagaatataaaaaaattagttagttgtggtgatacgcgtttgtggttttagttattttagaggttgaggtgggaggattatttgaatttaggaggtagaggttgtagtgagtcgagatttcgttattgtattttagtttgtgtaatagagattatgttttaaaagatatatatattttttttgattaaaatgaaatagaaataaattgtgtaatattgtttaaagatcgtattgataaatatattttttatttttagtattagtgtttgttataattagttttattgtttttagtaaatggttttatatgtaaatgttgtaaatatgaatatataatttaatttaaaaaatttttttgaattttttgtagttataaaaaaaaatgattaaataggattaataggatttttaatgttttaaatattatattttttagttatttgggaggttgaggtatgagaattttttggatttgggaggtgggggttgtagtgagtcgagattatattattgtattttagttttagtgataaagtaagattttattttaaaaaaaaaaaaaaatatatatatatatataagaaaattttttttattttatttttatttaggtatttttggtttaatttaagatttttggtttaaaaaattgataagaagaatattgataatattaattagtgtaaaatgaattaaaattagtgttttttttagtcgttttaattgattttggtgttttattgataaatttaatcgtttttttttatcgaagattttagatatagaatagagttatgtttatagatattaataagtttttttttttttttaaaataataattatgtattgaaaaaatagttattagtataaatttaatttttataggtattaaggtattaaataaagtttagatttagaaattttttagtgttcggattttatagttagttatggtacgatggaaaagtttaagaagagataagttagatgtgtgtttaattggttttgtattttttatgggatacgagaacgaggtgaaatgttataatggtaatgagatttttagtgatgtataaattaagtgggagattttgatttacgtgtttatttttatttatatgtttgtttgtttatttatttatttaattattttttatttttttagggacgaggttttgttttgttatttaggttggagtgtagtggtataagtatagttttttgtaatttcgaatttttaattttaggtgatttttttgttttggtttcgtaaggtgttgtgattatagacgtgagtagttatataggattgggagatatatttatagttttttacgggtaagatttattagtatgttttatgttattttaaggagtgagttttaaaagaagtgtttttagtatttaatagaattttaattaattttttttttattaatattttttttaattagtaaatattaaaatagttttttatatttttgtttaagaatattttatgtttttttattgttgatagtggaatagagatagtttggagtttagttatggagtgttttgaggttatgttaattagtttttttataataaaatagtttttaggcgtattaaatgttttatggttgttaaaataaattattataaatttagtgttttaaaatatatatttgataatttatagttttgtaggttagaagtttaaaatgggttttattaggttaaaattaaggtgtttgtagggttgtatttttttttagaggttttaagggggaatttgtttttttattttttttggtttttatagatttattgtattttatggtttatagtattttatttttatttttagagtaagtaatggtggattgagttttttttattttgtaggattgattttgtttttttttaaatttttttttttgatttttatttttttgttttttttttttatttttaagtaatttttttaaagatttttatatttggtttacgttaataatttaggatgatttttttattttaaagttattttattagttattttaatttttttttgttatataatttaatatatttatagattttggggattaggaagtagatatttgtagggagttattattttgttgattatattatagttttatttttaattattttagaatttttattttaataataaaattaattattagttttttttaaaatttatagttttttatttatatagtttttcgttattttattgagatattttagaaggttttagtatatggagattgaagatttaggtttaagttttgaattttttattttgtagtttgataacgttggaaaagttatttaatttttttaaggtttgattatttttttatttataaaatgggaataattgatttattttgtagagttgtaataaggattattatgtattatgaataagttttataaattgaaataattttttaaagtaaaggatgattaattgttttattggtttaaattatggtttggtttaaatataaatttttatgaagtaatttagtaatttatttagaattaatttatttttttttttttttattgtttttatattttttatggtataaatatattttgtatttgtgtgtatatattttttattttatttttgattattaaaattttaagggaagagtttttatttgattttgttttatattttatggtgtatattataatgttttttatataggtgtttattaaatattattttaaaaagtgattttaaattaattcgtaaagggtatttaattaagatgtttttacggaataatagtagagtaattgttaaataatattattgtaaaatataattttttattgaggaaacggaatattttaagttaaaattttggtttttgtatatggaaaaataaatgttgtgatgtagttacgggattaagtttttgagtttagttgttatattgtagaatttttttagtatttcgaggagtttttaaaatattaagaaagaatttgtgggtagtgtttaagttttggtatgtgttgttagggatgagaaatattaagtatttttttagattttgttttcgaagtttttattgtattatagtagggaaattattttgaaatagttttttaatttggagtgttatatagttttaggatttgtttataggagaaagaaatttatttttttttgttaaaaagttttttcggtattttgtataagtattggtaattaatatgagaaaaaatatgaaggattaataaatatatagaaaaatgttttggttatgtgtaatggtttatgtttgtaattttagtattttgggaggttaaggtgggtagattatttgaggttaggagtttgagattagtttggttaatatggcgaaattttgtttttattaaaaatataaaatttagttaggcgaggtggtatatgtttgtagttttagatattcgggatgttgaggtataagaattatttgagttcgggaggtagaggttgtagtgaatagagattacgttattgtattgtagtttgggtaatagagtaagattttgtttaaaataaaataaaataaaattaaaaaaatttagaagaatgttttagtatattaaatgattaaagaaatagaaataaatataagagtattataaaaataggtaatgatattttaaaataatattgtagggttagtgaggatatataagtttttaaaatgtttattacgatttgagtatgttttttaaaagtttgtgtcggaaatttaatttttaatgtaatagtgttgggagttgtagtttaatgggaggtatttacgttttatttttagtaatggattaatgtgttttattaaaaagtttgaggttataaatttgattttttgtttgttttggtcgttttttgttttttttttttttattttgggatgatataataagaaggtttttattagatgttggtgttatgtttttggacgttttagtttttataattatgaattaataaatttttgtttattataaattatttagttttaggtattttgttatagtagtagaaaatggataaaggtaatttttatatttaagtaagtttaattaaaagaaattattttatgtatagatatttttataaagatttgtaatttggtattatttgtattattgaaatgttagaaaaaattttaataattattaataatagtttggttaattatatttttggtatatttataagatgattaaaattacgttgtaaaatataattatatgatatataattatataatttatatattatgtgaaaatgtagaatattgtttgtttaatatgatataaattagtttttaaaaaataaattgcgtatgtatatagagaaaagtagagagagataaaatattatgttttttttttaggaattataagaatttcggtttttttgaattttataaaatttttataatttaatatatataatttttttttattttttttaagttaagtatttttaggttcgatattaattgaagttataatattagaggagagagaaattaatattttttatttaatttgtggttaaaggtagatttagattttgtggtgattagtagtttataataaaggggtagttgggtgggagggtttttaagaaaaatataaattaatttaagattgttagggttgtttttgtaagggttttagaaagggttatgtaattaggtttattaaattttattagttttatgataaatatgtttttaaattagtggtaaatattacgttaggtatttttatatatttaatttaataaaatttttatagagataaaggtattattatttatatgtatggaaaattgaggtttaaagaaattttaaaaagtatttaaatttatttaatagtgaaatggtagttcgtttttaaagttaatgttgattatattgttttattttttatgttttagtagtaattttttttattaaggtattttttagagtagtttgtatttttttaagttttattttttataaaaagttatttgtttaattgttattattttgatgtttattatatagtagttggttttgtagtagtaggtatttgataaatatttattgaatgaatggatttattataattagaataggtaaaaataagaaaatttaaatagatttgaaaatgtttttttagaatttataatgaatttatttataaatttttatttatgagaaaatatagatttttttggaaaatatttggaataaaatttttttaaatgtaggagatatttttatgttaatttagttaaataattaaagagaaatagagtttggggttatcgtatgggtattagtaaataagaggtaatgttaaggagtgggtatattagtaaaggtaaaataaattagaaaaattgtgatgatttaataatttagttattttaagttagttttgttttattgtttttgtaagatattaaatatatattagattaaataaaatttatgtatgtaaaatgtggtagtatttaggttttgaagatttgttttttggtgttattttagtgaatatattatattatatggtaaaaggaatttggtagataaaattaagtttattagttagttgattttaaaattatgagattattttgggtagatttaatgtaatgatatgagtttttaaaaattttaaattgtttattggttttttagtgtaattagaataaattttaaattttttattttggtttataattttgtataatttagatttgatttttattattttttttgtttttttttatttattttttttttatgttttagaattatttttcgtttagttttaaaaattttgtttttaaatttttaaatgattagttttttatgttatttaggttttggtaaaaatgttaaatttttaaagattatattttttatgattattttattaacgtattggtgttatttttatattttttattatatgatggagttttatattttaagtatttgagatttgaaaagttttatttatgtatttatttaattttttgttttttttattattgttttttaaagtggaatataaattttatgaagataagaattaagatttttttgtattgttttttttttcgtatttataatagtgtttggtgttttttgtttaatgtatgaatgtagatgatataataatgagtaagataatttataatttagaagaggattaagatatttatagaagaagttttaatataagggaatgtattgttaaagaatgggagattagatcgtttttagttaggtaattaaaaaagattttagagagaaagtagtaatagaattagattttaaggatgtttaggaattttttagggtagagattttaatattgtgtgttaggttaaaaaatttagaatttattatataggtaatgaaaatattaagtattttaaataaaaagggatatataattagaataagatttatagatattataggattagtttttagttttggtttaagaggaaaaataattagaaattatatgtatattgttattaatttatagttgaatgtaatggttaaaagtttttttaattggaaaatatgattgtaggaaaaaaaaaattaagttatattttttataaaaaagtttataaattttatgatgttgataaaataaaaaaaaaatataattatttttggtaattattttatttaattaataaaagatttagaaaaaattgtgcgtaagaattttatttttttaaatttttaatatgttttaatcggttaaaattttaattttaaggtatgtagtgttttttagggatgtttaatattttggtttttttgagtaatattggaagaattgttttgagttatatataaaatatattggtcgggtacggtggtttacgtttgtatttttagtattttgggaggttgaggtgggcggattatttgaggttaggagtttaagagtagtttggttaatatggtgaaatttcgtttttattaaaaatataaaaaaataataggtaggtatggtggtgggcgtttgtaattttagttatttaggaggttgaggtaggggaatcgtttgaatttaggaggtggaggttgtagtgagttgagattataatattgtattttagtttgagtaatagagagagattttgttttaaaataataataataaaaaatatagtaatattatcgatagttgatgagtttaaaaaaaaaaaattgtaaaaaaattttataatgttttaagatagtttatgaatttgtgttgggtcgtatttaaagttgtgggttggatatgtttattttaaattatttttttttatggagggataaaattttgatttttttttttaagttaaatgtttaaaataaggttttatgtttgtttgtatatttaagtatgttttttttaattttttttaatattttgatttttatttaaaatttaaaatagttataagatcgt

SEQ ID NO: 23 - DNA, 30714 bp, Artificial Sequence
  chemically treated genomic DNA (Homo sapiens)
cggtgtttggatttgtcgtttaggttggagtgtagtggcgtgtttttagtttattgtaatttttatttttcgggtttaagcgatttttttgttttagttttttaagtagttgggattataggtattcgttattacgtttggttaatttttttgtatttttagtagagaaagggttttatcgtgttagttaggatggttttaattttttgatttcgtgattcgttcgttttggttttttaaagtgttgggattataggcgtgagttatttcgttcggtttgttttataattttttgtattttatatttagtgttaggtgtttcggtttgagaagtcgaaggttagataagtgttataggatagtttagtaggtcgttaattcggtttgggagtgggtcgttaaggttttttagagaaggaaattttagagttaaggttggaatgaagaattggagtttagtttaagttgaagtagaatttatatattaattattgaattgtattgggttgtatttgaagtaaggtttatttagagttttatagtttgtttttttttttttttaatataaatattaatggattaattattttttagaaggaaaaagaaagtaattaaaatttattgagtgttgattttatggtaattattttgtatatattttagttaattttgatatttgttttatgagattggtattatttatttttattttatagatgaagaaattgggagtttaagaggttgataaattttgtttaaggtaaaaaattgggaagtatagttaggattttgattgtaaagttcgtgttttttttattatattatgtggttaagtttgttttttaagagtttttttagtggatatgtagaagtagttaagaaaatagtgggattggttttaagttttaaggaagaaaaaattttttggttattttttttggttaaagaaagttttggaaaggggtttttgggttatttttttggttggtattgtagcgttttattttattaagttagttttgttgaatttggatttggggaagtgagagtttataggatattttttgggagtgttcgttgaggtttgttttatatagtttatattttgttgtaaatagttcgttgtttttaattaaatttgtacgattatgtgtgaatttttaggaaatgaggatttttttttatggttttttttttagtgttaaaattagagtttttgttagtttacgagtttttttaaattgttgggttttgattttgagatttcggaatgtagtttagaaatgtttggattttggtataatatttagggaatgtttaagtgagaggatggttttaggtttgtagttatgttttttagaaggatgttttttgattttttttagtagggttttagggtattttaaatataggtttttgatgttatttacgttaggatagggaatatagattttttaattaaaattgttgtttgaagtaatttttgaagaaatagtattttaaaatgattatttttttttttagagaaagagttggttgaaattattttaatttgaaattgggtaataaagaaatgaatgggtttagttttttttaatgttgataaattaagaaaggaatatgtgtttattaaataaaatatgaaaaatatatataggtagaaagaagaaaaaaaagtgattatagttttattattgggagataatcgttatttagtattttggttagtttttattattaaaaaaattgttttttttgtttttgtttttgtttttttttgagagggagtttcgttttgtcgtttaggttggagtgtagtggtgtagttttggtttattgtaatttttgttttttaggtttaagtaatttttttgtttttcgagtagttgggattgtaggtgtatgttattatgtttagttaatttttatatttttagtagagagggggttgtattatgttggttaggatggtttcgattttttgatttcgtgatttatttgtttcggttttttaaagtgttgggattataggcgtgaggtattatgtttagataaaaaatttgtttttttaaaagaatcggtcggatgtagtggtttacgtttgtaattttagtattttgggaggttgagataggtggattatttgagattaggagtcgagattagtttggttaatatggcgaaattttatttttattaaaaatataaaattagttgggcgtggtggtgtgtgtttataatttttgttattcgggaggttgaggtaggagaatcgtttgaattttggagatagaggttgtagtgagttaaggtcgggatattgtattttagtttgggtgatagtgagattttattttaaaaaataaataaaaaaatcgtagtaagaatatttaatataaacggtaattttatatttattgaatagtaatttcgatttttggtgttttgtatgtttagagaaatttttttagtagtaaattatagaaaagatttttgaatgtgtgggttttttattatttatttttaatagcgagaataaaggtattaatttagttaatggttttagaatttgtttttttttttttttttttttattttattatttagattggagtgtagtggtgttaatatggtttattgtagtttttatttttttggttttagcgatttttttattttagtttttttagtagttgggattataggtgtgtgttattatgtttggttaatttttagtattttttgtagagaaggggttcgtttatgttgcgtaggtttgttttaaatttttgggtttaagtaattttttttttttagttttttgaatagttgggattataggtgtgtgttattatgtttagttaatttttggtattttttgtaaagaaggggtttttttatgttatttaggttggttttaaatttttggtttaagtaattcgtttgttttagttttttaaaatgttgggattataggtgtgagttattatgtttagtttatttttttttttaaggtggtattttttttagttttaatttttgtggatatatatatatatatattttaaatggggtatatattttgatataggtatgtagttataataattatattacggaagttgggatatttattttataagtatttattttttgtgttataaataatttaattttatttttttggttgtttagatgttttattttttttgtttttttttttttttttgagatagaattttattttgttgtttaggttggagtgtagtggcgcgattttggtttattgtaatttttgttttttgggtttaagagatttttttgttttagttttttaagtagttgggattataggcgtgcgttattatgtttagttaatttttatatttttagtagagacggggttttattatgtcggttaggttggttttgaatttttgattttaggtgatttgtttattttggttttttaaagcgttgggattataggcgtgagttattgtatttagttgagatgttgtatttttaatgttaattttttaatttttgtttattgtgtgtattgagattattaagtgatttttttatatattttttatgtagatttgtattggttagtatatataatagttgtttggtatgtgtgattgtgtaaattttaaattagttaaaaataaataaaaattaaaatttagtttttttgtttagttatattaaatgtttaataattatatgagattaggggttattgtgttggaatagggaagatataggatatttttatttttattgaaagttttattagatagtgttggtgtagattttgatttgtttagtttagttttaagaataaagttttgagtttagtacggtggtttacgtttgtaattttagtattttgggaggttgaggtgggaggattatttaaatttaggattcgagattagattgggtaatatagggaggttttgtttttataaaaatataaaaaaattagttgaatgtggtagtatgtatttgtagttttagttatttgggagattgaggtgggaggattgtttgagtttaggaggttgaggttgtagtgagttgtgattatattattgtattttagtttgggtgatagatagtaagattttgtttttaaaaaaaaaaaaaaaaaaaaaaaaaaaaaaaaaaaaaaaagatagtattttttattttaaataatgatagaacgtagaatattttttagtaataagaaaagttattttaagaagtagtaaagagatgggtttatagtttttgaaaaggaagttagttattagttattttttgatattttagtaattagttggttttgggagaagagtaggtatttttagagaggtgttaaataaataggataagagattataaaaatgaaaagttttttggttttttattataggataatttaatgtatgcgaattaatggtgaaaggtttagtaatagtttttgtgaggaaataggagtagtgtagtaggatatttttttttcgtattaaagtatttaatttttttaattttatatatagcggaagtaattaattgtattagaaagaaatttatagttggttttttttgatggttttataagtaataagtattattgtttagttttcgggatagatgtaaagttattttattgtattgttgagatttttttgaatgtttagtttgatttttttaaagataatttatgtgttaatatttaaaatttgattcgttttgttattatatatttttagtataagtaattgttaaaaagttaatttttattgtgttattgtattttagtttgggtaataagagtgaaattttattttaaaaaaaaaaaaaaagttaatttttgatttgtaatataatttagtacgtgatttgatgttggtattttttttaaacgttatgtgattgaattatgttatttatttttgtttgttttatatgtttatatgtagttgaattgtattgtttttgtttttgtggtattatttatagtgtggttatttaggaattaggtataataagattatatattaaaaatttagaaatttaatattttaaatgttggtttgtatggtattgttttattttttagatgtattaaaatatattatattttattaatttttagatgtatattttttttgatatttgaaattttttggaattgcgatattttaattaacgtgttagggtttaattggtaaggttttttttttttagttgtatataaaataatgatggattttataattaatagtatttatgttgttttttgggtggaaaaaatttataacgaaatagtattttagttttgatgatatatggtatatatagttaaaattttatgagtatgatgtgttattgtaagtgtaataatagaataattttttatttattttttttgagatatggtttttttttgttgtttaggttggagtgtagtggtatgattatagtttattgtaatttttgttttttgggtttaaggggtttttttgttttagtttttcgagtagttgggatgataggtaagtgttattatgtttggttaatttttgtaatttttatagagatggggttttgttatgttgtttcggttggtttggaatttttggatttaagcgatttgtttgttttggttttttaaagtgttaggattataggggtgagttattgtgtttggtttagaataattttttttattaagaaaaatatttacgttaattaaataaataaaaattttaattatatattttatatgggattttaattgattttattttgataaatatataatttgttatttttatttttttttttattaattaattagtttttttaaataatatttatttttttttttttttggtgttgaaatttatagtcgaaaatatttatttttttgattataaaagtaatattgggtcgggtatagtggtttacgtttgtaattttagtattttgagaggttaaggcgggcggattatgaggttaggagtttaagattagtttggttaatatggtgaaatttcgtttttattaaaaatataaaaattagttgggtgtggtggcgtatatttgtagttttagttatttaggaggttgaggtaggagaattatttgaattcgggaggtagaggttgtagtgagttaagattatattattgtattttagtttgggcgatagagtagatttttaaaaaaaaaaaaaaaaaaaaaaaagtaacgtataatattgtttattgtgggggagataaagtttatggaagaaaataataattatttattaggttattatagaatattgttaacgttttttttttattttaggataatttatttttttataaatatatatatttaataatataaaattaataaatgtttaaatatattttgttaaatgttttgaaaggtatataatgttatataataaaaaagcgggttttttaagtaagttagggattagtttttttattgttattggagtagaattttttggtgttcgataggattacgtgtagatgttgtaatgtataattttagggagtattattcgtgttaggtaggttgcgaatggtatttttttaaagttgtgtaatttagtaattttggtgtttagtatcgtgattatagcgatagtggtatatacgtaggggagatagataggagggaggatgtaatagtatagtagatgtattaaggagtttgtaattatttattaatttttaaaataatggattcgtagaagtaaggatttaataattggtaagttttagtggtttgggattgtttttttgatattacgtgtattttggtattttttaaattgttttttttaggttgagaggtttttatttatgttgaagaataaaggtatgaaaatttatttgtgagaaagatataagaatagttaagttatgtggaaagttagtgatgtagattattgagagaaaagtttaaggagatgaggatggagtagttaaagatgattttttggaagaggtggtatttaggtagtatagggaggagaatggtattaaatggagaatgaatatggtttattttttagaaagtagtgagattagtttaacgaaatgttattttatagtagtgtttttagatttaatgggattggtgttttataatagaaatttaaataattgggtaatattagttgaaagagggaatgattaattaggaggagagttagtagtatttaggatcggaggaagaggggttttaaggtaggtagtaaattaaatggaaattaatttgtattttaaaataaatattgataagtattggttattggttatatatatgattatgtatgtttttgaaataataaaggaagttgttttaaagtttatttattgagaataagttgttagatgatagttttgttattatgatgtataggatttgttagtagatttttattttaataagataagtgttttattattaatttttaaaaatatggaaaaataaaataaaataaaatatttaattttgttttggttaatagaaataaaaagaaatgcgttagggtaaattattagtagagaataaaattaagtatgttatttatttaataaatatttattgattatttattggtgtgttaagtagtatattggatataatggagtgagaatgagatagtttttattttttgaatttttgagtttagtatagggttaggtatttttaatatattcgatgggtaaattagtatgtttggttatattggtgatattatattatatttaggaatatattttaattattatgtaagttatggatagtaggtatagtatggtgtttatgaatttgtatttttgatttagattttatttttttagttattttagtttgaattttttattatcgtattttgttttttttttattagttatttttaaggtaattatatttagttttatatgttggatttttggattattagttttaaaggaatttttgagtagaattagtgtttagggatattaagaagaattagatatgggtttttttatttttgaatgtatgtatgggttttttgtgtgtatatatataaatatatgtatatgtatacgtatatatatgtatatatgtgtatatgtatatttatatatgtatatatatgtacgtatatatatgtgtatatatgcgtgcgtatatgtatatgtgcgtatatacgtatatatgtacgtgtgtatatacgtatatgcgtacgtgtgcgtatatacgtatatgcgtatatatgtgtgtatatatacgtatatgcgtatatatgtgtgtatatatacgtatatgcgtatatatgtgtgtatatatatgtatatttgtgtgtatatatatatatatatgtatatatttatatatgtatataaatatttatatatatatataaagtttagattagaaatttatttgaattatatttaatagattatatatatatatatttttattatatttggattaatttttagttagaaaaaaatatatatatagtttttttttttttgaaatagagtgtcgttttgttgttcgggttggagtgtaatggcgagatttgggtttattgcgataagcgatttttttgttttagttttttaagtagttgggattataggtgtttgttgttatatttagttaatttttgtatttttagtagatatagggttttattatgttggttaggttggttttgaatttttgattttaaatgatttatttattttggttttttaaagtgtttgggattattagtataagttattacgtttagttaaaattatatataatatatttttaatatgtatttagtgtatgtttagagtatatatattatatatagtttttatttggttaaaaaataatttaagtgtaataaattaggtgttgtgaggatagggaaaagtagggtagtgagttgtagtaggatagggaaggttaagatttattgtgggttgcgtgggagttggggtagggaggttttagttttcggtgttcggtgggaggaattatagttttttaggtagtgtttgatagttagagagtagtgagtaaataataggtggtagtttaggagcgtagtggggatggggatatttagtttgaggtaatgggggaagggaggtttaatagatagatagaatatagatatagggagtttagaaataaagagttggaggtaattaagtgatgttattaataatatttataattgtttagtagtttgggtgtagggatgtagttaagtttaaataataagtagagaaattttaggttttggtaagttaataggttagggttttagatataagagaagggttgttagtttttagaaaggggcgaggtagtgggaggttgagttttgagtttgggattaaagttttgataattttttttgttttaaggtttaggaaagattaggttttatggtaaagggtgtacggatagtagggaaaggaggaatatagaggttacggattaggtaggattaagtgagagtagtaatattttttattatttattttttaattatagtagttagtgttttgaggtaaagataaattaaaatggagttaagggagaaggagtaagttgtttagaagtaaataaaagaagtaaaatattgtattattataatgaaaatgaatttaggtttttaaattttttttattttgtgtattgaattatatatatttattttatttttaattatagtttttgttttagtttagtttttttaagttatgatggggtattattaattaaaaaaaaaaaaaaaaaaaaaaaagatgtagtagtgtttatgttgaaaaatgaagttgtttattttttttaatatttatttatttaatattgggtttgaagttaatttaaagggttattttattaatggtatttttttattcgtgtttttttattggtttttaatttattattagatttagagatttcgtgttgttttttgttttataagatttttataatatgaaaatgattttgaatggattagtttggattaatttatttattttggatttttgaaggtagaagttttattttattgaagaggatgtgatttatagtttttttagttaatttttattttttttaagatagttatgttattttttaatattaaaagggttttggtgataaggtttagaaatgtttagaggatatgtatgtttatttttttttttttatttaataaatatttatttgttaggtattaggttttgaggagagagttgagaatagattgataaagttaagttggtttgtagttttagttatttgggcggttgaggggggaggattacgtgagtttaggagttttaggttatagtgaattatgattatgtcgttgtattttagtttgggtgataaagtgagaatttgtttttaaaaaaagagagattgataaagttttttgtttatggagtttatattttagtggagtagaggggtttagattataaataaataattaaatgtacgatgtaattaatgaatgttgttttgggtatgtaataattattttttttgtgatttatttggatagaagaaaagattatttttagtttattttagtaatttatttaaaggaatattaatatattacggaatgttaattgtggatttcgagatgttgtttttgagtttgggggttagaatatacgtgtttagatgtttttttgggtagatagatcggagaaacgggttggtatgtataaatatgttagtagttagggagaatagtatgttttattagttgttggtagttagggcgttgaggattgaagtttgggtattagttgggttttattaaaggagagcgaaaaatttttgaagatttgaaaaggagagttttttgtagagaagtaaatatattacgatttaaaatttgatgttttaattttgtttttatttttatagtggtagataatataagttagggaatatttatttgtatattttagaaatttgatgtattaaggtttttatttgagattgttgtttattttatagattaatttatatgtttaaaaatttaattagattataaagagtataataatacgtttgttatggttttttttgtcgatatattgtttagtatacgttaatgagagttttgattaattaatgtgaatttttttaagtaaaaggtttatttttttttttagaattaaagttggggttgggcgtagtggtttacgtttgtaattttagtattttgggaggtcgaggcgggaggattacgaggttaggagatcgagaatatttattaatacggtgatatttcgtttgtattaaaaatataaaaagttagtcgggcgtggtggcgggcgtttgtagttttagttgtttaggaggttgaggtaggagaatggcgtgaatttaggaggcggagtttgtagtgagtcgagatggcgttattgtattttagtttgggcgatagagcgagatttcgttttaaaaaaaaaagaataaaaaaattttaaaaaataaaaaaattaaaattgggtattatgaaggaaatttgagaaagaaaagtgattaattttagttgatgtaagtaattttacgtatttttttttttttgtatagtaagatattataatttatgattgttaaatttgagatagttgaagagtttagaaaaaaagattagggaagaaaatagaattgaaaaataatttagaatgatagaggttatttgtagtattaagggtaaaggcgggtaaaagaagaaaagggagatagaataaaagataaattaaaaaattgaaataaaatatacgggaatttaaatatttatattagaatataagggaatattttggaatttaaatatttttttaggtaagaatgtgtgttaatataaatgtttggtatattgttttttttttttttttttttttatttagtttatttagttttaaaagtgattttttaaaatgtatttttaaaagaatattttttgttaagtgatttaaatttgatatattttttggattattaaggaggttaaagttatatttggtgaaaaaggggtttattttttttttttttatatacgggttatcgaatatttttaaaagtattttttattatgaatgaggggaaatggaagaaaagaggtggtgataattatttgtattttttaaatggacggaatgagttttcggagggtatacgaggttattagcgtgagttcgcggtggagttggaggcgtatttatagttggttgattttagttttgttgggttttcgtcgttttttattttatgtcgttggaattcgcgggttcgtaggttataggagttcgggcgcgtcgggtttggcgttttcgaatcgatgagggaagtcgtttttttcggtagattttttcggtcggggagtttttattattttgtttgcgtttcggtacgttggtaaggagttcgggaagagacgtcgggagcggtgggtgggcgagaaataaatgtaatgtgatttatatttttttttgtcgtaattattacgatttggttattttttattttggtgatttggtgtttttttagcgattttattttacgttagttgattggcgtttatcgtagtgtgagtgtcggtcggaggaggggtttacgcgaaagagttcgcgagagtggggatattcggtttcgaaggtcggagcgggcgtttagggcgtcgatggtcgtagcgttcggtagtcgtgtttacgttttttttcgtcgcgttttatcgcgtgttatttacggcgtttgcgggaagttattcgggcggtagttgtggggttggtttgtggggaggggtcggcgggttcgcgcggaggagtagtttcgattttcgttcgtattagtagttcggcgtttttttgtcggcggttggttttttttttcggtaattgggcgtcgggtttcgcgaatttttcgggcgttttcgtcgtgcgttcggtttttttcgtgttcggggcggggcggggtaggcgttcgtggtcgggtgcgcgcggcgcgggcgggggtttttttagtgcgcgcgcgtcgtgtaaggttcgcggacgttcgttttttttttaggttttcgtattcgcgtcgttttttttttttttggtaagagtcggcggcggtggcggcggtcgttgtagagattggaattcgtttgtcgggtttggcgaaggagaagggaggaggtaggagcgaggagggaggagggttaagggcgggtaggaaggtttaggttcggcgcgttcgttcgcgcgcggcgaagatcgtacggttcgatcgaggggcgatcgggtcggggtcgttgtacgttaagggcgaaggtcgattcgggttttatttcgtttcggcggttcgtcgcgtttattcgtttcgcgtcgagggttggaggatgcgttttttggggttcgggtgagttgggagtgcgcgtgcggatcggaggggttggtcgtagcggggaggttagaggggttcgggcgaggttgtagaggtagttgggcgcgcggtggtcggagttaggggttgttcggttcggtttcggtagtttcgtaggtttcggcgcgcgttgggtcgggatcgtttagttagagatttacggtatttcgcgtcgcgtttttcgtcggttttttttttgttttttattcgcgggttgtaggtcgagtttggggatgcggagtgggcgaaagtcgtttcggggacgtttttggaatttttaaatgggaaaggcgtttattttttcgtttcggagcggcgaggttgatatttgtgatttggtttcggacgttgtggggaggaataggggagaataaaatgagtttcgggcgggggtcgagtgagaggagtagtcggttcgttttcgagttttcgcgggaaggggttttggttttcgagttttcggagttgttttatttgttgttttgcgcggttttcgtttcgtggtttggtgatttcgtattttagttttggaaaattttttgttggattgtttggatttttttttttttttttagatttttagtggaaagatttggtaaggaaaaaaaaatgagtttgcgttagggaagaaaaataatatgttgtgtgttagggtttggcgtttgagcgtggtatttttttatgtttttagatgttttaatttggttaaatttttgtaggtttttttttttaagcggttaataaattgtttagagtatatagtatgaatttggtatttgtgttacgttatttaatttttataacgattttggtttattgtattttttattgttttaggggaagaaatcgagtcgtaaagaggttaattaatttgtttaagggagttgggatttgaatttaggaatatcgtattttggtaaacgaattaggaagaaaaaaaattaaaattgtttgtaaatatttttacgtttaggaatattttttagttatttttatttgaaattatcgttattttgttgttggagttgaaaataattattttattgtatttatttgtgagaggagttaaattttgaattagagtgtaatttaatgcgttttattgtttttagttgttgaaataaagaatgtgaattagaattatttagatttttaaatttgaagttaaaatatgggtaattttttgatttaggaatggggtgagtgtatgaaaggtcgattgaaatgtagaatgcgtttttagtagaattagatttagtttttgtttaattttttttttatttttcgtggagtttattttaaattttttttattttttttatttttttttattttttatagaagaggttgaggtatttagtaggagtttttttattaaattttttttgttattggttttttaatttttcgttaaagagggagaatttttttttttttttttgttttttttattagttaatattttggggttttttttttttttttttaatttttttgtttagtggagcgtgagttattttttttgtcgtatttgggttttttaaagtataaatgtttttaagatttttttagtttataaaaatttttttttaagtttgttatttttttaagttgttttgttgttgttttttttttttaaattttattaatattttaaaaagtttgttcgtaataaaagtaatatatggttgttaattgcgaattagcgtaatattgaaattaaaatttagttatttataatttatttttagagattgttaagtgtagtttgttttttttgtttttgtttggttggtggttagttatttattttttaattttttgttatttggattttatttttataaggaattataatttaattaatatatttaattatttttttttaagttttttttttgagttttttgtaagatttaatatcgattttatatttttagatgtttttttttgggttttatttatttatattcgttgtattttaatatagggtttaaggtagtaagatataatagattttttttttatggagtttaaagtttagtggggaaatatttattgaaaaataaagtttttagttaaatataattgtgattttaattaaggtgtagaatattataagaattttaaatggagatttgatttggtgtttgtggtggtgggagaatttgggaaagatattttaaaattgttttgttggaatttaggtagattgtgaaggatgagtaagagttaattattaattagatgaagaggggttttttgtgatattatattgattttgttttttttcgttatttttttgttttttgtttttttttttttttttaatatgcgttttttaagttttattttttagattatttttttttatgtttttagttttttagaatgattgtttagatttttttgttggaataatttttaattttttgtttatgtgttttttgaattacgtttttttgtttgtttgttttgtttttttttttttatttagttgttttttatatatttgtatttgattgttttgagttgtttttttttagtaaatttgtttttttggtgttttttatttttgttgatgttatattaaatttaaatttttttttattttattatattttgtttgtagttaatatttgttgattttgttttatgatattgtaatttttttgttttttatttttgttaattgtggggtaattttgaatttatattggtgtgaaggtagtagttaaattataaaacgagttgggtagtttttttttttttttttttttttaggattattttagattgggattatttgttttttgaaagtttggaagattttttttatgtgattatttaggtttagattttttttttggagaggattttgagtaatattttaatttttttaatagttgttggtttgtgtcgattttttgatttttatatgaattttaatgttttatattttttttaggaatttatttttaaatttagtgttatttggtttttacgtagttttttttttattatttcgcgattttatttttattttttaattttaaattaagtttttattttatttggattaatgttatgatttttttgtttttattttttttttttatttaattttatgtatttttgtttaaattaatttgtaagtttagtttttattatttcgttatttagaagttttttaggttttttattaaatgaaatattttttgtggtatttgttttagatttatttgtttttttttttttttttttttaatattttattgttttttttttttttttttttttttttttttttttttttttttttttttttgatatagagtttcgtattgtcgtttgggttggagtgtaatggcgtgagtttagtttattgtaatttttgttttttgggtttaagggatttttttgttttagttttttaggtagttgggattacgtttggttaatttttgtatttttagtagaggtggggttttgttatgttggttaggttggttttaaatttttgattttagttgattcgttcgttttagtttttttgtgttggggttatataggtgaggtattgtggttggtttttatagtagtttttatataaatattagttttattattagtttgtagggtgggtttgtaacggattttttttgtatattaaaaggaataaatggggaaaggtttttgtttagtttaatagtagttgttgaattgttttgatttgattattggattttaggagtagcgaattatggagagaaaggaaaatgggttttttattatattaaattttgaagtaggaattattttttttttttttttatttttttattttttattagtttttaggttttaggatgtttttttaatattataaggtttatattgattaagttggattaattttttaatataagattaaatgttgatttgtattgagttatgtttattgtaagatatatagtagtgttatagattatttaaaatatgtttttagttgtaagaagttattgattgtaaggtgtattttaatttcggagatgttaaaatatgaaaaatggatgtattttagaattgatgaatagtgtttttttttttaattaaagtttttggatgtgtttggaaatttttagtagtgttttttgaaaagaatattagttaggggtatagggagattagatgattagtagattttattttagggtggtttttgtggtttttaagttagttcgtatgggtagtttaatatataattaatgagtagatattgaatagatgagtaaattatttttgagtattttttatttattttgatgttgtagattttgttatttttttatagttttatatttttgatgagttttttttttttatggtatagatttgttatattgttaaagtttggaatagtggagtttggtttttgatttagttgtatataattggttgttgatttatgaaggaggataggagtatgttagagatagggataaaatattataattatatttgtagttagggagattagttatatgttggaaaattattttgaagaaaggaagattgaagatgtttaaatttgtaggaaggtttttttggtttagttcggattaaatttatttatgtttagtgttttattattggaacgttaagtacgtgggagttatttatattttgtttaaggttattattaaggtttgattgtaaaaatttaaaaaattgtagttttaggtataaatgggttaagatggtggtagataattagggtttggaatggataggaggcgataattagcgtggatgagagaaggaatgggattggtaagaataatttttggatttttagtttggaaagtagggtagatgtgggtgatagatatgaaaaatgaggtgggagagttggtttgtagaagaaaatagtattggattatatggagtttgagatatttgaaatagttaagtagggatttttatttggtagttgtttatatgggtttggggtttgatagaggtttgtgttggaggtaggtatttgggagttattgttgtatagattttatattttaatagtgggaattgggtggtttttttaagtgatttttgtttataagtgatagttttaatttaagttagtttaaaggagggaaaagtttttttttattaatttttatgatattgaaaggtttagaaatagatatggttggatttaagtgtttaaatgatataattaattgaggttgttttttttgttttttatttttgtggttttattttaggtaggtgtatatatttggtagaggaagatataggttataggttatagaattataggttataggttatagatttcgtatcgagaattttttgtatggtttagtaaagagtttaaaatagtattgagaattttttttttttttttttgagacggagttttgttatgttttttaggttggagtgtagtggtgcgatttgggtttattgtaattttcgttttttgggtttaagtgattattttggtttagtttttcgagtagttgggtttaataggcgttcgttaatacgtttggtttttttttgtatttttagtagagatagggttttgtttcgtgggttaggttggttttaatttttgattttaggtgattttttcgttttggttttttaaagttttgggattataggtgtgagttattgcgtttggttagttttgagaaattttaatttaaggtttgggtagagaagatagatattaaataattatttagttgtagttatgttaagatttataaaaaggaagtttagggaatgttataagattgataagggaagttgggttgtttaggatgcgggtattttggaaggtttttttgagaaaggtagttcgtagagtgagattttaggtaagaaaggataaggagattgtttttggaagtatttagtagtatttatttatttatttgagacggagttttattttgtcgtttaggttggagtgtagtggcgtgattttggtttattgtaatttttatttttcgggttaagcgatttttatgttttagttttttaagtagttggggttataagcgtgagttattacgtttggttaatttttgtatttttagtagagacggggtttcgttgtgttggttaggttgatttcgaatttttgatttcgtgattcgtttatttcggttttttaaagtgttgggattataggtatgagttattgcgttcggttagaagtattcggtaaagtgagtagtttttgtagttttttaaaaattttaaaggtaatatatttattgtgggtaatttgggaagtataaaaagttataaagaagtagcggaatgattaagttttagtttttaattttttataaataatgtttgatattggttttattattgagtatttatttaattacggatgttatattaatttaattcgaattttcgtttttttattttaaaaaatagaaggaatatggtgaattttaagataatttttttgtttaaaaaaagaaaaagaaagaaaatattttgatttgtagtatagttagttgtcgaaattgaaggttatataatgtttttggttttaatgatattattggatttttgatttttggttgaagaattacgttagttttggtagtttttgtaagtattaaagggagtatggtttatgtttgcggtgtttttttcgtattttgtttttttatttttttttttgagtattaatttttttttttttagtttttgggtaaagtattaaaatgttgagaagatagatttttaattttgaaggtgagaaatttgtaggagatttggatagttgtttttttttttttttttttgagacggagtttcgttttgtcgtttaggttggagtgtagtggcgtatgttggtttattgtaagttttgtttttcgggtttacgttatttttttgttttagttttttgagtagttgggattataggagttcgttattacgtttagttaattttttttattttttagtagagatagggttttatcgtgttagttaggatggttttaattttttgatttcgtgattttttcgttttagttttttaaagtgttgggattataggcgtgagttattatatttggttgatttggatagttttgatattgttttatgtatattaagatttgtaggtagtttttttattagtaattaaaatgttttgtaatgtattttaagagtatagggttttgagtgttttaaatttgtatataagaatgttttagatttttggttaaaagaagtttttgttagaaaatattaaagtaaaggttgttaaattttggtgaggtttttaatgtttgtattttttaagaattatttaaaaatgttatgaaataaaaatattttagtggtaattgtttagaagtattttaaatgtatattaaattaatgaaatataatcgttgggtgatagattattttttttttattttataattttttatttaataaaaatgtgggggaaaaattgtatgttgaagttgtacgtgtatattttagtaaaaattgttaatttttttgaagtattgttttggttattatttttatttgttaaatatttttttttgtttttttatttgtttataatagaaaatttagaatattttggattggttttttgttttggttaagttagttttttttgttttgtttttttttttattattttattagtttaagttacgtaaatattcgatttaggtttgggtttagaatttttagatttttattgtttattataatagatagttattattatatgtggttgttgaagatttgaattgtggttagtttaagtgtgaattacgtattagattttgaagatagtattaaaagatgtaaaatattttattatgtttttaaaatattggttatatagtgagatgatattgttagggatatattggattaaagaaatatattaaaattgattttggtcgggtatggtggtttatgtttgtaattttagtattgtgggaggattgtttgagtttagtagtttgagattagtttgggtaacgtggtgagattttgttttagttaaaaaaataaaattgattttataggattttttttattttttaaatgtggtaattagaaagtttaaaattatacgttatattggatagtattgtttttgatttttttttttttggttttttgtttattagaatgttttaaaatttagtataaatttttggttaggtgttgtggtttacgtttgtaattttagtattttgggaggtcgaggcgggaggattacgaggttaggaattcgagattagtttgattaatatggtgaaattttatttttattaaaaatataaaaattagtcgggtgtggtggtacgtttgtaattttaggtatttaggaggttaagataggagaattatttgaatttgggaggtggaggttgtagtgagtcgagattgtattattgtattttagtttgggcgatagagtaagattttgttttaaaaaaaaaaaaaaaaaaaaaagaatattttttttttttttatgaagttttttttagtggtttaagttttatagttggttttttgttgtattattatttgaagataattttttggtatattagatttttttattataaatttttttagaatttttaatatgttaatatatatggtgaaattttagtatagtttttttaattacgtattattatagaattgtgtgttttttgttaatagaagttatatatatttgtggttgaaattttaaataatatagaaatgaagtaatgaaagttttttgtaattatgttttatttgtgttttaagattgttattgttgaaagtatagagttagaaaaaatttttttttttgttgttttttttttttttttttgtttttattttttaaaatggggttatacgatatatttttatttttaaatttatttttattgaatatatagggggattttttttatgttagtaaattttaatttttttatttttttttttttttttgagggaaggttttgttttgttgtttaggttgtagtggtgttgtggtgtaaatagtttattgtagtatttaatttttgggtttaagtaatttttttattttagttttttgaatagttgggattagaggtgtatgttattatgtttagttaattaaaaaatttttgtgtgtgtggaggtgggattttattatgatgtttaggttggtttcgaatttttgggttaaagtgatttttttatttaggttttttaaagtgttgagattataggtgtgaggtgttgtgcgtagttttaattattttattttttatagtagttaagtagttattttattttttgattatattttaattttatttattagtttcgtgttaatgaataattagattatttttattttttttttttgtattgtaaatatgttgtggtgtttgtatatattttttgagattgtttttattttatgaaatgaatttttagaaatgtatttattataagagaagtcgtgtagattggatggaaagtgttaagttattttgtaaaattttcgtaattatttatattttagttaatagtatttgaatatgttttttttttttaatataattatattagttttttttttttttttttgagacggagtttcgtttttttatttaggcgggagtgtagtggcgttatttttgtttatagtaagtttcgttttttgggtttatgttatttttttgttttagtttttcgagtataggcgttcgttattatatttggttaatttttttttgtatttttagtggagacggggttttatcgtgttagttaggatggttttttttttttttttggagatcgagttttgttttgttgttaggttggagtgtagtggtgttattttggtttattgtagtttttgtttttcggatttaagtgatttttttgatttagttttcggagtagtttagataataggtgtacgttattatgtttagttaatttttgtatttttagtagagatagggttttattatgttggttaggatggttttgatttcgtgatttcgtgattcgttcgttttggttttttaaagtgttgggattataggcgtgaggtattacgttcggttatattagtttgtttttatttttgttagtttgttagttgaaaaaatatttatgatataaggtttttttgttgttgtatgaatattaaaaaataaaaaattttaagttttatttgttttatatttttaatttgttatacgtttttttgatttttgtgttaaaatatttcgtattgttaatagtatatatgtatgttttgtataaagtaaatgtttagatatttgtatttgtttatggtaaaggcgtttagaatatgttattgtaatataaaaattatttggaaatttggtggtttatgtttgtaattttagtattttgggtggcggaggtaggaggattatttgagtttaggagttttagattagtttgggtaatatgttgagattttgtttttataaaaatttaaaaattaatgagatgtggtggtatgtatttgtagttttagtaatttaggaagttgaggtggggggatcgtttgagtttaggagttcgagattgtagtgagttatgattttatattgtattttagtttgagtgataaagtaagattttgttttaaataaataaaatatatattttaatttggaaatatttgagaatagtttttttttttttttgaatttttttgtttgtttaaaattagatttttttttaaagaatttaattgttataatttttagttgttataaattttttttttgggagttttgtaagtagggaagatggttttttgtcgttggagagaatttggtattatatttaaatagatattgttataaattattttatgtttaattgttgttttaagggtttatttgttttttttatatgttatttgtttttttgtaatagtttattgtttttttttagttttagtttttttagtaagatggtatatatgttttaaattcggatagtttttttgggttatatttttttgtgaattattttatatatgtgaattaaatttgttattttttttgtagatgtgttttttgttagtttaatttattagattttaattattgaatttaagagggtgtaggaagttttttttttttgataatggttaaattgatatttttttggttgtaagggtaagggataataataaagtaacgtttttttaagaataaatataaatattttaaatataaagagcgtgagtaaagtttttttaaagtatattaaaaaaattgttatttaaaatgaaatatttgttaaaagaagtggattatgttattaaagatgtgttttttatttttatgtgtttgtttttatcgtagtaatgttgattgttaatggatggtatagtaattttaattgtgtttataggtttttgtttttaaaattatgtatttttttttgtttttttttagtattttattaatttgtatagaagagaaaatgatttgtaataggtttttttggttatattattgaggagagttaataaaagaagttatttaattgaggttaaatttttatataaagaaggtattaatagtttaaaagaataaagaaattttgatatggttattgtgatttttttatttatttggttatgaaataattaaaaaggttaattaaatgttggtttatttttaggtttagttatgtatcggtgtgtttattgttttttgtgttttattatattttgtttattaggtttgtgattttgagttaaagttgttaattattttaagttttttttttttatatgtgaaataaggataataatggtttttttttttagggttattgtgaggattaaatgaatgatgagtgtagtttagtgtttaatattgtgtttgttattgtagtagtttaatgaatgttagtgaagatgagtatttttgagagaaataagtaggatagttttattttaaaatgtaggtttgaatggttttatatatagggtttttgaaaattaaatttgattttgttgttttttaaaagtatgtattattttagtttttatgttaatatttatatttgaatttgtaaaatgtttttgtgtattattagtattggtaaattgatataggaaattttgttgttttttttgttttgtatattaagaattggaggttaatgaaggttaatttttttattaatgttaaataagttggtgtaaaagagtaaatagatttagagttgaattttgtagttttatttattagggaggttgaggtgagaggattatttgaggttaggattttgtagttgtaatgtattatgagaataatgtgttatgtaaatagtaattgcgttttagcgtggataatatagcgagattttgtttttaaaaagaaaaaagtaaatagaattagatttttttttatttatttagagtggatgattaggattttaaagttatatataaagtaaagttaaagattttatatgttaaagaaagttttaggtattagtggttagaattttttttagggtttattaagatgtggtagaattaggttataagttggggggagaaggaattgtgttagaattgttattgtagttattagtttgtttagtagggagtattgtagttttttttttttttttttttttttggagtgttttttttttagaaatttagtgtggagaggtttaagagaattatttttggaggttaagaatattagtagaagatggaatggagtatttgattatttaggtagtattaattacgtagtaggttggtttatttgtatttatttgagtaaaggataaggaaaattagaaattttagtgtggatggaggggtggtagtgatttttttttagtttaggtgggtaatgtagatgtaattaggtattagtttttttgttaggtaggttgtgttggataggggagtaaaagtagttggaagagggtgagttgaggttgggtaaggtgatgtagatttataatcgtagtattttgggaggtcgaggtgggaggattattgagtttaggagttcgagattagtttgggtaatatggcgaaatttcgtttttataaaaagtataaaaattagttaggcgtggtggcgggcgtttgtggttttagttgtttaggaggttgaggtggtagattggtttgagtttaggaggttgaggttatagtgagttgagatcgtgttattgtatattagtttaagtgatagtgaggttttgtgttatatttttagttttttgggtaattgaggtaggaggattgtttgagtttagaaggttgaggttgtagtgagttatgattttattattgtattttagtttgcgagagagagattttgttttaaaattaaataaaataatataataaatggagggtgagttgaagtagatttttaggtgggttgagagtttttagttttttttgttatgaaagaattttatttgtttttagaagaaaagttattatttgtttgtttgtgatatagatagtgtagttagtattagttaggaaagtggtaattgagatagttattttagtttttttttttttttttttatttattagattatatttttttttttaggttagtttttttggattgggtgtatttaatttgaatttgaagagaaaggaggtgattgtaagattgaagattaacgttttaaattgtattttttaataattaaaagttataggaattttttaagatttttataagaagtggaaaagggagatttgattaattataattagggatagggatagagaaataattgttttttgtgtttgtatcgattttagattttttgttaagagttttaagtttttattattttaagtttttattaaggtttttggatatattaagtttttattaagtttttattaaggtttttggatattaaattttatttttttttttttcgtatgaggttgttatagtattatagatgattatttgatttttttagtggtttgtttttaaatgtattttgatttttaatattattttagtattaagtgtattatttaattttattttagatttataagttgtatattatatgataatttttttaattggaatattaatttaaatattttaatttttttttatggaattgttggagtttattaaattttggaaacgttaaataatataaaaagtatttaaaaagaaatattaatttaatattttatttttatttagtgtttgagattttgaattttagaaagttttaaattaatatttagttgttatttatatataaaaggtaagtaggttttagtttaaagaatgttgagtaataaaatataagattgagatggattaaatggtatttgatatatttttttattttgaatcgatttaatttttataagtattttatgatatagttattattattagtttttttttatatgaggaaattaaggttgtagaggttaagtagtttgttaagggttgtatagtttttaagtggtagagttgggatttaaatttaggtagtttggattttagagtttatgtttttaattatataattatattgttaaatggaggaggagaattttaagatgaggatgtgtattaggtatagagttgatttttaataattaattttttttttaatatttaaaacgtggtagagattttttatatttaaattttttatagttaatttttgagattgattgattgattgattgaagtagggttttacgtattttattttttaggtaggagtgtagtggtgtgaatatggtttattgtagtttcggttgtttgggtttaagtttagattttttcgttttgattttttaaagtgttgggattatagttgtgagttattgtgtttggttttaatttatatttttttattttattgattttgttttttttttgtattttaaataatattaaaaggttagtggtatatagttgtttaaaaaaatatttatttaaaattttttttatatattttttttaaaaattagtgttttttttttttttatttttgagatgtatatatgtttaattggcgatggttagagataggttttttttttttttttttttttgagatagagtttttttttgtcgtttaggttggagtatagtggtacgattttggtttagtgtaagttttatttttcgggtttacgttatttttttgttttagttttttgagtagttgggattataggcgttttttattatgttcggttaatgttttgtatttttagtagagacggggttttatcgtgttagttaggatggtttcgattttttgattttatgatttttttattttggttttttaaagtgttgggattataggcgtgagttatcgcgttcggttagagatagatttttttttatagttttattatgagtattatttttaaaataaatgattttgggtaggtgtttgtataatataattatgttatttgtatcgttttatagaataaattaaaatttattttgtgagagaataagaagaaaaagagagttagttgaaaatgaaagtgattaagtttatttgtggggtagtttttggagttagattgagaaatgaaatttgatttttatttgttaatgttgttgaataataataatatggaatattattaaattgtttttgtttttttaatagttatttaaatgtaattggttatggtatgtagacgtttaaaaattattttatttttttaaagtttttttttaaaataagtttttttttttttttgattgtaaaaataatgtttatagaataaattgaaatatatagaaaagttttgagaagaaagtaaaaattttttgtatttatattatttaaaggtaatatttataaatattttggtatatatattgtaagtttaaaaaattttataatgtttttattgtaatttaagaatttgtgtaaataagttgagtaaagttaagtttattttgagcgtttgaatttggaatataaggaatttgaaatttgtaggggtgggggtatttgaatagaaatagaaagttttgaaaatttggttgttttattttagttatttttttttttttttttttttgaatgtttttttttttttttttagtttttgttatttttaagtttttttttttaattaagatgttttatatttgatatgttttttagtaataatagattaaaatataataagatgtagggaagtagaatttaaattgtaggaggttaaaaattagatgaaggttaggtgtggtggtttacgtttgtgattttagtattttgggaggttgaggcgggtggattatttgaggttaggagtttgagattagtttagttaatatatagtggaattttgtttttattaaaaaagtataaaaattagttgggtatggtggcgggtatttgtaattttagttatttgggaagttgaggtaagagaattatttgaattcgggaggtggaggttgtagtgagtcgagattacgttattgtattgtattttagtaatagagtaagatttcgttttagaaagaaaaaaaaaaaaaaaaaaaatataatattagatggaaatagaaaatttaaaatttttagtagaatgaagttagaaagaatggaatttaaatattgaaattatatatttgttaggtagttgtgcgttttttatttataggttttgttgtggaaatagtaaaagaaattttgaaagaaaaagatattttaaatagattaagtatatatttttattattgtgatatgtatatttttagttgtatagtatgtattttattttttttttttttttttgagatagagttttattttgtcgttaggttggagtgaagtggtgcgatttcggtttattgtaatttgtgttttttgggtttaagcgatttttttgttttagttttttgagtagttagaattataggcgtttgttattatatttggttaatttttgtatttttagtagagatagggttttattataatggttaggttggttttaaatttttgattttagatgatcgttcgtttcggttttcgaaagtgttgggattataagcgtgagttatcgcgtttagtttttaa

SEQ ID NO: 24 - DNA, 30714 bp, Artificial Sequence
  chemically treated genomic DNA (Homo sapiens)
ttaaaggttgggcgcggtggtttacgtttgtaattttagtattttcggaggtcgaggcgggcgattatttgaggttaggagtttgagattagtttggttattatggtgaaattttgtttttattaaaaatataaaaattagttaggtgtagtggtagacgtttgtaattttagttatttaggaggttgaggtaggagaatcgtttgaatttaggaggtataggttgtagtgagtcgagatcgtattattttattttagtttggcgatagagtaagattttgttttaaaaaaaaaaaaaaagaatgaaatatatgttgtatagttaaaaatgtgtatattatagtgataagaatatatgtttagtttatttaagatattttttttttttaaagttttttttgttatttttataatagaatttataaataaagaacgtatagttgtttagtagatgtataattttagtgtttagattttattttttttagttttattttgttagaggttttagattttttatttttatttggtgttgtgttttttttttttttttttttttttttgagacggagttttgttttgttgttggagtgtaatgtagtggcgtgatttcggtttattgtaatttttatttttcgggtttaagtgatttttttgttttagttttttaagtagttgggattataggtgttcgttattatgtttagttaatttttgtatttttttagtagagatagggttttattatatgttagttaggttagttttaaatttttgattttaggtgatttattcgttttagttttttaaagtgttgggattataggcgtgagttattatatttggtttttatttggtttttaattttttatagtttaggttttgtttttttatattttattatattttagtttattattattgaagaatatattaaatgtgaaatattttgattaaaaaaaaaaatttaaaagtggtaaaagttgagaaggaaaggaagaatatttaggaaaaaaaaaaaaaaaagataattagaataagatagttaaatttttagaattttttatttttatttagatatttttatttttataaattttaagttttttatattttaggtttagacgtttaggatgaatttagttttatttaatttatttgtataaatttttaaattatagtagaaatattgtagaattttttaaatttatagtatatatattaaaatgtttatagatgttatttttgagtagtataaatataggggatttttattttttttttagggtttttttatgtgttttaatttgttttgtaagtattatttttgtaattaggagggaaaaaagatttgttttgaaaagaaattttaaaggaatgggatgatttttagacgtttatatgttataattaattatatttaaatgattgttaagagaataaaagtaatttaataatattttatattattattatttagtagtattaataggtaaaaattagattttattttttaatttgattttaaaaattgttttatagatggatttaattatttttatttttaattgattttttttttttttttgtttttttatagggtaggttttaatttattttatgaaacgatataaataatataattatgttatgtaagtatttatttaaggttatttattttaagagtaatatttatggtaaagttgtgaaaaaagatttatttttggtcgggcgcggtggtttacgtttgtaattttagtattttgggagattaaggtggggagattatgaggttaggagatcgagattattttggttaatacggtgaaatttcgtttttattaaaaatataaaatattagtcgggtatggtggaggacgtttgtagttttagttatttaggaggttgaggtaggagaatggcgtgaattcgggaggtggagtttgtattgagttaagatcgtgttattgtattttagtttgggcgatagagaaagattttgttttaaaaaaaaaaaaaaaaaaaaaatttatttttgattatcgttaattaaatatgtatatattttagagatgagaaaaaaaaaagtattaatttttaaagaaggtatgtgggaagaattttggataaatatttttttaaataattatatgttattgattttttaatattgtttaagatgtaaaggaaaaataaaattagtaaagtaaaaaagtataaattggagttaggtatagtggtttatagttgtaattttagtattttgggaggttaaggcgggaggatttaagtttgagtttaggtagtcgaggttatagtgagttatgtttatattattgtatttttgtttggggaatggaatgcgtgagattttgttttaattaattaattaattaattttaaagattaattgtggaaaatttaaatgtggaaaatttttattacgttttaaatattaaaagagaggttaattgttaaaagttaattttgtgtttagtatatatttttattttaaaattttttttttttatttgataatataattatgtggttaagagtatggattttaaaatttagattgtttgggtttgaattttagttttgttatttaggaattatgtaatttttgataagttatttaatttttgtagttttagtttttttatgtaaaagggaattgataatagtaattatattatagaatatttgtaaaggttaaatcgatttagagtaaggaaatatgttagatattatttaatttattttaattttatattttattgtttaatattttttaaattaaaatttatttattttttatatgtgaataatagttgaatattaatttaaaattttttaaaatttaaaattttaaatattaagtaaaaataaaatattgaattagtgtttttttttgagtgttttttatgttatttaacgtttttaaggtttgataaattttaataattttataaaaaggaattaagatatttgaattaatattttaattaaaagggttattatataatatatagtttataaatttgagataaaattaaatgatatatttaatgttaaaatagtattgagaattagaatgtatttggaaataggttattgagaagattaaatggttatttatagtattgtgatagttttatacggagaaaaagagaatgggatttggtgtttaaaggttttggtgggaatttaatgggaatttaatgtgtttaaaggttttaatgggaatttaaggtaatgggaatttaaggtttttaataaagggtttgaaatcggtataaatataagaaataattgtttttttatttttatttttaattgtggttggttaaattttttttttttattttttatggagattttgaaaagtttttatagtttttggttattaaaaagtatagtttaaaacgttaatttttagttttataattattttttttttttttaaatttagattgggtgtatttagtttaagagagttagtttggaggaaggggtgtggtttgatgaataggggagggaggagagagattggagtagttattttagttgttatttttttggttaatattgattatattgtttgtattataagtagataaatgatagttttttttttggggataagtggggtttttttatgataaaggagattagaggtttttagtttatttgaagatttgttttagtttattttttatttgttgtattgttttgtttggttttgagatagggtttttttttcgtagattgaagtgtagtgataagattatagtttattgtagttttaattttttgggtttaggtagtttttttgttttagttgtttaagaagttgggaatatgatatagggttttattgttatttaggttgatgtgtagtagtacgattttagtttattgtagttttaattttttgggtttaagttaatttgttattttagttttttgagtagttgggattataggcgttcgttattacgtttagttaatttttatattttttgtagagacggggtttcgttatgttgtttaggttgatttcgaatttttgagtttaatgatttttttatttcggttttttaaagtattgcgattataggtttgtattattttgtttagttttagtttatttttttttaattatttttgtttttttgtttagtatagtttgtttggtaagaaggttggtgtttggttatatttgtattatttatttgaattaaaagaaggttattgttatttttttatttatattgggatttttaattttttttattttttgtttaaataggtatagataaattagtttgttgcgtaattaatattgtttaggtaattagatattttattttattttttgttagtatttttaatttttaggaatggtttttttagatttttttatattaagtttttaagggaaggatattttaagggaaggagaagggaagaaaaattatagtgttttttgttaggtaaattaatagttgtaatgataattttggtataattttttttttttttaatttgtgatttaattttgttatattttaataagttttggaaaggattttggttattaatgtttagggttttttttagtatgtggagtttttgattttattttatatgtaattttgaggttttaattatttattttgagtgaatgaggaaaagtttgattttatttatttttttttttttagagatagggtttcgttatgttgtttacgttgaagcgtagttgttatttatatagtatattatttttataatgtattatagttgtaaaattttggttttaagtgatttttttattttagtttttttagtaggtagaattatagagtttagttttagatttatttatttttttatattaatttgtttgatattggtgggaaaattaatttttattagtttttaatttttgatgtataaagtaggaaaagtaataaaattttttatattaatttgttagtattgatgatatatagaagtattttgtaaatttaaatgtgaatattaatatggaagttaaaataatgtatatttttagaaagtaataagattagatttaatttttaaggattttgtatgtgaagttatttaaatttgtattttaagatagaattgttttgtttattttttttagaaatatttatttttattaatatttattaagttattatagtggtaagtatagtgttaagtattgaattgtatttattatttatttagtttttatagtagttttgagagagaggattattattatttttgttttatatatgagaaaagaaggtttagagtaattaataattttggtttaaggttataaatttagtaagtagagtgtaataaggtatagaaagtaataaatatatcgatgtataattaaatttagaaataagttaatatttaattaatttttttagttattttataattagataaatggaaaagttataataattatattaggatttttttatttttttaagttattaatgttttttttgtgtaaagatttaattttaattgaatgattttttttgttgattttttttagtgatgtgattagagaaatttgttataaattatttttttttttatgtaaattgataaaatgttaagaaaaaatagggaagagtgtataattttaagaataaaggtttgtgaatataattaaagttattatgttatttattaataattagtattattacgataggaataaatatatgggggtggggggtatatttttaatagtataatttattttttttaataaatgttttattttggataatagtttttttaatgtattttaaagaaattttatttacgttttttatatttaagatatttatatttatttttagaaaaacgttattttattattattttttgtttttatagttagaaaaatattaatttggttattgttagagaagaaaaattttttatatttttttaggtttagtaattgaggtttgataaattaaattgataaagaatatatttgtaagagaaatgatagatttgatttatatatgtagaataatttatagaaaaatgtgatttaagggggttgttcgaatttggggtatgtgtattattttattaggggaattggaattagaaaagaataatgggttgttgtaggaaaataagtaatatgtaggaaagataaatggatttttaggataatagttggatataggatagtttataataatgtttgtttaggtgtggtgttaaattttttttagcgataagagattattttttttgtttgtaaaatttttaaggaagggatttatgataattggaagttatgataattgagttttttgggggaggatttagttttaggtagataagggagtttaggaggaaaaaaaagttatttttaaatgtttttagattaaaatatatgttttgtttgtttgagatagggttttgttttgttatttaggttggagtgtagtgtaagattatggtttattgtagtttcgaatttttgggtttaagcgatttttttattttagttttttgagttgttgagattataagtgtatattattatattttattgatttttaaatttttgtagagatagagttttaatatattgtttaggttggtttagagtttttaggtttaagtgatttttttgttttcgttatttaaagtgttgggattataagtatgagttattaggtttttaaataatttttatgttgtagtagtatattttggacgtttttgttatgaatagatataaatatttgaatatttattttgtataaagtatgtatgtgtattgttagtaatacgaaatattttagtataaaaattaaaggagcgtataataagttgagagtataagataaatgaaatttaaaattttttgttttttaatatttatataatagtaaagaaattttatattatgaatgtttttttagttggtaaattggtaaagataaaaatagattgatatggtcgggcgtggtgttttacgtttgtaattttagtattttgggaggttaaggcgggcggattacgaggttacgagattaagattattttgattaatatggtgaaattttgtttttattaaaaatataaaaattagttggatatggtgacgtgtatttgttgtttgagttatttcggaggttgagttaggagaattatttgaattcgggaggtagaggttgtagtgagttaggatggtattattgtattttagtttggtagtagagtaagattcggtttttaaaaaaaaaaaaaaaattattttggttaatacggtgaaatttcgtttttattaaaaatataaaaaaaaattagttaggtgtgatggcgggcgtttgtattcgggaggttgaggtaggagaatggtatgaatttaggaggcggagtttgttgtgagtagagatagcgttattgtattttcgtttgggtgaaagagcgagatttcgttttaaaaaaaaaaaaaaaagattgatatgattatgttgggaggagagaatatatttaaatattgttggttggaatatgaatggttacgaagattttgtagggtggtttggtattttttatttaatttgtacggttttttttatagtaaatgtatttttaagaatttattttataaaataaaaatagttttaaaggatatgtataaatattatagtatatttgtaatgtaaaagaaaaaaatggaaataatttaattatttattaatacgaaattggtaagtaaaattaaggtataattagaaaatggaataattgtttaattattataaagaatgagatgattaaggttgcgtataatattttatatttgtaattttagtattttgggaggtttaggtgggaggattattttagtttaggagttcgagattagtttaggtattatggtgagattttatttttatatatataaaaattttttaattagttgggtatggtagtatgtatttttggttttagttatttaggaggttgagatgggaggattgtttgagtttaggagttggatgttgtagtgagttgtttgtattatagtattattgtagtttgggtaatagaataagatttttttttaaaaaaaaaaaaaagaatgaggaaattgaaatttattgatataaaaagaatttttttatatatttagtgaaaataaatttaaagataaggatgtatcgtatgattttattttaggaaatggggatagaaaaaaagaaagaaggtaatagaaaagaaaattttttttagttttatatttttaatagtggtaattttggggtataggtgaagtatgattatagaagatttttattattttatttttgtattgtttgaaattttaattataaatatgtgtaatttttgttaatagaaaatatatagttttatggtaatacgtagttagggaaattatattagagttttattatgtgtattagtatattaaaagttttgagaaggtttgtagtaaagaaatttaatatattaaaagattatttttaaataatgatgtagtaaagagttaattatgaggtttggattattgaggagggttttataggagagagaggaatatttttttttttttttttttttttttgagatagagttttattttgtcgtttaggttggagtgtaatggtgtaatttcggtttattgtaatttttattttttaggtttaagtgatttttttgttttagttttttgagtatttgggattataggcgtgttattatattcggttaatttttgtatttttagtggagatggggttttattatgttggttaggttggtttcgagtttttgatttcgtgattttttcgtttcggttttttaaagtgttgggattataggcgtgagttatagtatttggttaaggatttatattagattttaaagtattttgatgggtaaagaattagggaaaggaaagttaaaggtagtattgtttaatatgacgtgtaattttaaattttttagttgttatatttaaaaagtaaaaagaattttgtgaaattagttttgtttttttaattgagataaggttttattacgttatttaggttggttttaagttgttgggtttaagtaatttttttatagtgttgggattataggtatgagttattatgttcggttaaaattagttttaatatatttttttaatttaatgtatttttaatagtattattttattatataattaatattttaaaagtataatgagatattttatattttttggtattatttttaaaatttggtacgtaatttatatttagattagttatagtttaagtttttaatagttatatgtggtagtggttatttattgtagtggatagtagaggtttaaggattttgaatttaaatttgaatcggatatttacgtgatttaggttgataaaatagtaggaaaggaagtaaagtagaaaaggttgatttggttagagtaggagattagtttaagatattttggattttttattgtaagtaaataagaaaatagggaaaaatatttaataaatagggatgatgattaaagtagtattttagaaagattaatagtttttgttaaaatatatacgtataattttaatatgtaattttttttttatatttttattaaataaaagattataaaatgaaggaagaataatttgttatttagcgattatattttattgatttggtatatatttaagatatttttgaatagttattattgaaatatttttattttatgatatttttaaatgatttttgaaaaatgtagatattaagagttttattaaaatttaatagtttttattttaatattttttaataagagttttttttagttaggaatttaaaatatttttatatataaatttaaaatatttaagattttatatttttgaaatatattataaagtattttaattattagtaagaaaattatttataaattttaatatatataaaatagtattaaaattatttaagttagttagatgtggtggtttacgtttgtaattttagtattttgggaggttgaggcgggaggattacgaggttaggagattgagattattttggttaatacggtgaaattttgtttttattaaaaaatagaaaaaattagttaggcgtggtggcgggtttttgtggttttagttatttaggaggttgaggtaggagaatggcgtgaattcgggaggtagagtttgtagtgagttaatatgcgttattgtattttagtttgggcgatagagcgagatttcgttttaaaaaaaaaaaaaaaaaaataattatttaagttttttatagattttttatttttaaaattgagagtttatttttttaatattttgatattttatttaaaggttaaagaaaaaaaaattaatgtttaaaaaaggaggtaagaaagtaggatacgggaagggtatcgtaggtataagttatattttttttggtatttgtaaggattgttaaggttggcgtgattttttagttaaaagttagaagtttagtgatgttattaggattaaaagtattatatgatttttaatttcggtagttaattgtgttgtaagttaagatattttttttttttttttttttttaagtagaaaaattattttaaagtttattatgttttttttattttttaagataaagaaacgaagattcggattgggttagtgtggtattcgtgattgaataggtatttagtagtaaaattagtattagatattatttataaaaaattagaagttgaaatttaattatttcgttgtttttttatggttttttatattttttaaattatttataatagatgtattgtttttaaaatttttaaaaagttgtaaaaattgtttattttatcgaatatttttggtcgggcgtagtggtttatgtttgtaattttagtattttgggaggtcgaggtgggcggattacgaggttaggagttcgagattagtttgattaatatagcgaaatttcgtttttattaaaaatataaaaattagttaggcgtggtggtttacgtttgtgattttaattatttgggaggttgaggtatgagaatcgtttaattcgggaggtagaggttgtagtgagttaagattacgttattgtattttagtttgggcgatagagtgagatttcgttttaaataaataaataaatattattgaatatttttaaaaatagtttttttgtttttttttgtttaaggttttattttgcgggttattttttttaggaaagttttttaaagtattcgtattttgaatagtttagttttttttattagttttgtaatattttttggattttttttttgtagattttaatataattataattagataattatttaatgtttattttttttatttaggttttaagttgaaattttttaagattggttaggcgtagtggtttatatttgtaattttagaattttgggaggttaaggcggaaggattatttgaggttaggagttgagattagtttggtttacgaggtaaaattttgtttttattaaaaatataaaaaggagttaggcgtattggcgggcgtttgttaaatttagttattcgggaagttgagttaggataattatttgaatttaggaggcggaggttgtagtgagtttagatcgtattattgtattttagtttgggaaatatagtaagatttcgttttaaaaagaaagaaaaaaaatttttaatgttgttttaggttttttgttagattatataaggagttttcgatacgaggtttataatttataatttgtaattttataatttataatttatgtttttttttgttagatatatgtatttgtttgaaatgagattataaaagtgaagaatagaaaagataattttaattaattatattatttgagtatttaggtttagttatgtttatttttagattttttaatattatgggggttagtggggagaagttttttttttttttaagttaatttgagttagggttgttatttgtaagtaagagttatttgagagagttatttaatttttattgttggaatataaaatttatatagtaatgatttttaaatgtttatttttagtataaatttttgttaaattttagatttatatagataattgttaagtggaaatttttatttggttgttttagatattttaaattttatgtgatttaatattatttttttttataaattagtttttttattttattttttatatttgttatttatatttattttgttttttaagttagaaatttaggagttgtttttgttaattttatttttttttttatttacgttagttatcgttttttatttattttaggttttaattatttgttattattttaatttatttatgtttgaggttgtaattttttgaatttttgtaattagattttggtgatgattttgagtaggatataaataatttttacgtgtttagcgttttaatagtggaatattaggtataaatgggtttaattcgggttaggttagaaagatttttttataagtttgaatatttttagtttttttttttttaaaatgattttttaatatgtaattaatttttttaattgtaaatgtgattataatattttatttttatttttagtatatttttgtttttttttataagttaatagttaattatatatagttggattaagagttaagttttattgttttagattttaatagtataataaatttgtgttataagaaaggaaggtttattagaaatataaaattataaaagagtaataaagtttataatattagagtaaataaaagatatttaaagataatttatttatttatttaatgtttatttattagttatatattaaattgtttatacgaattggtttagggattataggggttattttgagatggagtttattgattatttgatttttttatgtttttaattagtgttttttttaaaaaatattattggggatttttaggtatatttaagagttttgattagggagagaaatattatttattaattttaagatgtatttattttttatattttagtattttcggaattggggtgtattttataattaatggttttttataattagaagtatattttaagtggtttgtaatattattgtgtattttataatggatataatttaatgtaagttaatatttaattttgtgttaaaaagttggtttaatttggttaatatggattttgtgatgttaaaaagatattttaaagtttaaaaattagtaaaaggtgggaaagtagaaaaggaaaagaaatggtttttattttaaaatttagtgtgataggaaatttatttttttttttttttatggttcgttgtttttaagatttaatagttagattaggatagtttaatagttattgttaggttagataggagtttttttttatttattttttttaatatgtaagaaaagttcgttatagatttattttgtaaattagtagtgaaattaatatttgtataaaaattgttataaaggttagttatagtgttttatttgtgtaattttagtatagggaggttgaggcgagcggattaattgaggttaggagtttaagattagtttggttaatatggtaaaattttatttttattaaaaatataaaaattagttaggcgtggttttagttatttgggaggttgaggtaggagaattttttgaatttaggaggtagaggttgtaatgagttgagtttacgttattgtattttagtttaggcgatagtgcgagattttgtattaaaaaaaaaaaaaaaaaaaaaaagaaagaaagaaagaaagaaagaaaaaataataaggtattaaaaaaaaaaaaaaaaaaaaataggtaaatttgaggtaaatattatagaaaatattttatttaatggaagatttaggaaatttttgagtggcgaagtggtaagaattgggtttatagattaatttaggtagaaatatataagattagataaaggagaaaagtgaaggtaagaaaattataatattagtttaggtgggatgagaatttgatttagagttagggggtgggggtggagtcgcggggtggtggggggagaattacgtgaaagttaaataatattagatttgaaaataaatttttgaaaaaaatgtgaaatattaaaatttatatgagaattagaaaatcgatataaattaatagttattaaagaaattgaagtgttatttaaagttttttttagaaaaaagatttaggtttaaatggttatataggggaggttttttaaatttttaaggaatagataattttagtttaaaatgattttgaaaaagagaaaaagaaggaaagttgtttaattcgttttatgatttgattattatttttatattaatatgaatttagaattgttttatagttagtaagaatagagagtagaagagttataatattataaagtagaattaatagatgttggttatagataagatatgatgaaatgggaaaaggtttgggtttggtatgatattaataaaaataaagaatattaaagaggtaagtttgttaaggaaaagtagtttagaataattaggtatagatatgtagaaagtaattgaataaaaaagaaaaaataaaataaataaataaaaaaacgtgatttagaagatatataaataaagaattgagaattattttaatagaaaggtttgaataattattttaagggattagagatatagagaaaagtgatttgaaaagtgaaatttggagaacgtatattaaagaggaaagaagaaatagaaggtagaaaagtggcggagaggaataaagttagtataatgttataaaaggtttttttttatttagttaatagttaatttttgtttattttttataatttgtttgggttttaataaagtaattttaaggtattttttttagatttttttattattataagtattagattaggtttttatttgaagtttttataatattttgtattttaattaaaattataattatatttaattagagattttattttttaataagtatttttttattagattttaagttttatgagggaaggatttgttgtattttattgttttggattttgtgttagaatatagcgagtatagatgaatgaaatttaaggagaggtatttgaaaatgtgaagtcgatgttaaattttatagaaaatttaaggagaggatttagaaaaaggtagttaaatgtgttgattaggttatagttttttgtgaaggtgaaatttagataataaggggttaagaaatgagtggttagttattaattaggtaaaggtaggaaaagtagattatatttggtaatttttagagatggattgtgaatgattaaattttaattttaatgttgcgttagttcgtaattaataattatgtgttatttttattacgaataagttttttaaaatgttaataagatttgaaaaggaaaagtagtaataagatagtttgaaggagtagtagatttaagaaaaggtttttgtaaattgaaaaaattttaagaatatttgtattttaaagaatttaaatacgatagagaaaataatttacgttttattaagtaggaaaattagaaggaaaggaaaaaaattttaaggtgttaattaataagaaagataaaaaaaaaaaaaaaaattttttttttttgacggaaggttaagaagttagtaatagaaggaatttaatgaaggagtttttgttaagtgttttaattttttttgtaaagggtggggagaagtgaagaaagtagaaaaagtttaaagtgggttttacggaaaatggaggaaaaattaaataagaattgagtttggttttattaaaaacgtattttatattttaatcggttttttatatatttattttatttttagattagagaattgtttatattttagttttaaatttaaaaatttaaataattttggtttatattttttattttaataattgaaaataatgagacgtattaagttatattttaatttaaagtttaattttttttataagtaaatataataaagtagttgtttttaattttagtaataaaatagcgataattttaagtaagagtaattgaaaaatgtttttaaacgtaaaagtgtttgtaaatagttttggttttttttttttttaattcgtttgttagaatacgatgtttttgggtttaaattttagtttttttagataagttagttaatttttttgcgattcggtttttttttttaaaataatgaggaatataataaattagaatcgttgtaaggattaaatgacgtaatataggtgttaagtttatattatgtattttgaatagtttgttaatcgtttaaaagagaaaatttgtaggagtttgattaaattaaaatatttgagagtatgaaagagtattacgtttaaacgttagattttaatatatagtatattattttttttttttgacgtaagtttatttttttttttttgttaaatttttttattaggagtttggaaagagaaaaaagggtttaggtaatttagtagaaagttttttaaaattgaagtacggaattattaggttacggagcggaggtcgcgtaggataataggtgaagtagtttcgggagttcgggggttagggttttttttcgcggggattcgggggcgggtcggttgttttttttattcgattttcgttcgaaatttattttgtttttttttgtttttttttatagcgttcggagttaaattataaatattagtttcgtcgtttcggggcggggaggtgagcgttttttttatttaaggattttagaagcgttttcggagcgattttcgtttatttcgtatttttaaattcggtttgtaattcgcgagtgggagataaaagaggggtcggcgggggacgcggcgcggggtgtcgtgggtttttggttgggcggtttcggtttagcgcgcgtcgaggtttgcggagttgtcggggtcgggtcgggtagtttttggtttcggttatcgcgcgtttagttgtttttgtagtttcgttcgagtttttttggttttttcgttgcggttagttttttcggttcgtacgcgtatttttaatttattcggattttagggaacgtattttttagttttcggcgcggagcgggtgggcgcggcgagtcgtcggggcgaagtggggttcgaatcggttttcgtttttggcgtgtagcggtttcgattcggtcgtttttcgatcgggtcgtgcgattttcgtcgcgcgcggacggacgcgtcgagtttaagtttttttgttcgtttttggttttttttttttttcgtttttgtttttttttttttttttcgttaagttcggtaggcggattttaatttttgtagcggtcgtcgttatcgtcgtcgatttttgttaggaggggagggggcggcgcgggtgcgggggtttgggggaggggcgggcgttcgcgggttttgtacggcgcgcgcgtattgggaaggttttcgttcgcgtcgcgcgtattcgattacgggcgtttgtttcgtttcgtttcggatacgaaaagagtcgagcgtacggcggaagcgttcgaagagttcgcggagttcggcgtttagttgtcggggaggagggttagtcgtcggtaagggggcgtcgagttgttggtgcgggcgggagtcggggttgttttttcgcgcgggttcgtcggtttttttttataagttagttttatagttgtcgttcgggtagtttttcgtagacgtcgtaggtagtacgcgatggaacgcggcggaggggagcgtggatacggttgtcgggcgttgcggttatcggcgttttggacgttcgtttcggttttcggggtcggatatttttattttcgcgggttttttcgcgtggatttttttttcggtcgatatttatattgcggtgaacgttagttagttggcgtgaaataaggtcgttgggaaggtattaagttattaaggtgggggatggttaggtcgtggtagttgcgataaagaaaaatataagttatattgtatttgtttttcgtttatttatcgttttcggcgttttttttcgggttttttgttagcgtgtcgaggcgtaggtagggtgatggaggtttttcggtcgggaggatttgtcggggagagcggttttttttatcgattcgggagcgttaggttcggcgcgttcgggtttttgtgatttgcgagttcgcgaattttagcggtataagataaggagcggcgagggtttaataggattgaggttagttagttataaatacgtttttagttttatcgcgggtttacgttggtgatttcgtgtatttttcggaggtttatttcgtttatttggaaaatgtaaataattgttattatttttttttttttatttttttttatttatggtggaaaatgtttttaaaagtattcgatgattcgtatgtgaggaaagaggagataggttttttttttattaaatgtgattttaatttttttagtaatttaagaaatgtattaagtttaagttatttaataaaagatgtttttttaaaggtgtattttaaaaaattatttttaaaattgggtaaattgggtaaaaagaaagggggaaggaaaataatgtgttaggtatttgtattgatatatatttttgtttgaagaggtgtttagattttagggtatttttttatattttggtataaatgtttgaattttcgtgtattttgttttaattttttggtttattttttattttgttttttttttttttttttattcgtttttgtttttaatgttgtagatagtttttgttattttgaattattttttaattttgtttttttttttaatttttttttttgggttttttagttgttttaggtttgatagttatgggttgtagtattttgttatgtaggaagaagaggatacgtgagattatttgtattaattaaaattggttattttttttttttaagttttttttataatatttagttttagtttttttgttttttggggtttttttgtttttttttttttgagacggagtttcgttttgtcgtttaggttgaagtgtagtggcgttatttcggtttattgtaagtttcgttttttgggtttacgttatttttttgttttagttttttgagtagttgggattataggcgttcgttattacgttcggttaattttttgtatttttagtatagacggggtgttatcgtgttaataggtgttttcgattttttgatttcgtgattttttcgtttcggttttttaaagtgttgggattataagcgtgagttattgcgtttagttttagttttagttttaaaggaaaagatgggttttttgtttaaggagatttatattgattggttaaagtttttattgacgtatgttgagtaatgtgtcggtagagaaaattatggtaagcgtgttattatgttttttatagtttagttggatttttagatatatgaattggtttataaaatagataataattttaggtgggaattttagtatattaagtttttgaaatgtataaatgagtattttttggtttgtgttatttgttattgtagaaatgagagtaaaattgaagtattaaattttaagtcgtgatatgtttgtttttttgtaaaagatttttttttttaaatttttaggaatttttcgtttttttttgataaggtttagttagtatttaggttttaatttttagcgttttggttattagtagttagtggggtatgttgttttttttggttattggtatgtttatgtatgttagttcgttttttcggtttgtttgtttagggagatatttggatacgtgtgttttggtttttaaatttaaaagtaatatttcgggatttatagttaatatttcgtaatgtgttggtatttttttaagtgggttattagaataggttggaaatggtttttttttttgtttaggtaggttataagagaggtagttgttatatgtttaaagtagtatttattaattatatcgtgtatttagttatttgtttgtggtttgagtttttttgttttattagaatataaattttatgagtaaaagattttgttagtttttttttttttagagataggtttttattttgttatttaggttggagtgtagcggtatagttatagtttattgtaatttggaatttttgggtttacgtgattttttttttttagtcgtttaagtagttgggattataggttagtttgattttgttaatttatttttaattttttttttagagtttagtgtttggtaagtgaatatttgttaaatgagagaagagaaataagtatatatattttttaggtatttttaaattttgttattaagatttttttagtgttagagggtggtatggttattttggaaagagtgaaggttggttgggaaagttgtggattatattttttttagtgaaatgggatttttgtttttagggatttaaggtgaatagattaatttaagttaatttatttaaagttatttttatgttgtaaagattttataaggtaaaaggtagtacgaagtttttgggtttgatgataagttagaggttagtaaggaggtacgagtgaaggaatgttattggtagggtgattttttaggttggttttaaatttaatattaaatgggtaggtgttagggagaataaatagttttattttttagtatggatattattatattttttttttttttttttttttttttggttagtagtattttattatggtttagaaggattaaattgaaatagaaattgtggttaagaataagatggatgtatataatttagtgtataaaatagaggaagtttaaaaatttgaatttatttttattgtggtggtatagtgttttattttttttgtttatttttaaataatttgtttttttttttttagttttattttaatttatttttgttttaaagtattggttattatgattgaaagatagatgatggaggatattgttgtttttatttggttttatttagttcgtggtttttgtattttttttttttttattattcgtatattttttattatagaatttgattttttttaggttttgaggtaggaagaattattagagttttggttttaagtttaagatttagttttttattgtttcgtttttttttaagaattgatagttttttttttgtgtttgaaattttgatttgttagtttgttaggatttggaatttttttgtttgttgtttggatttagttgtatttttgtatttagattgttgggtagttgtaggtattgttggtggtattatttaattgtttttagttttttgtttttaggttttttgtatttgtattttatttatttgttgggtttttttttttttattattttaggttggatgtttttatttttattgcgtttttggattattatttgttgtttgtttattattttttggttattaggtattgtttagaggattatggttttttttatcgagtatcgggagttggggtttttttattttaatttttacgtagtttatagtagattttggttttttttgttttgttgtagtttattgttttgtttttttttatttttatagtatttggtttattgtatttggattattttttaattagatgaaaattatatataatatatatgttttggatatatattaagtatatattaaaggtgtattatatgtaattttggttgggcgtggtggtttatgttagtaattttaagtattttgggaggttaaggtgggtggattatttgaggttaggagtttaagattagtttggttaatatggtgaaattttgtgtttattaaaaatataaaaattagttggatgtggtagtaggtatttgtagttttagttatttgggaggttgaggtaggagaatcgtttgtcgtagtgagtttagatttcgttattgtattttagttcgggtaatagagcgatattttgttttaaaaaaaaaaaagttatatatatatttttttttggttaaaaattaatttaagtgtaataggggtgtgtgtgtatataatttattgaatataatttaaatagatttttagtttgaattttgtgtgtgtgtgtaggtgtttgtgtatatatgtaagtatatgtatatatgtatatatgtatatataaatatgtatatgtgtgtatatatatgtgcgtatatgcgtatgtgtgtatatatatgtgcgtatatgcgtatgtgtgtatatatatgtgcgtatatgcgtatgtgcgtatacgtgcgtatatgcgtatgtgtatacgtgtatatatgcgtatgtgcgtatatgtgtatgtgcgtacgtatatgtgtatatgtgtatgcgtgtatatgtgtgtatatgtaagtatgtatgtatatatatgtatatatatgtacgtatgtatgtatatatgtttgtgtgtatatatataaaaaatttatatatatatttaaaaatgaaaagatttatgtttgattttttttagtatttttaaatattgattttatttaagaatttttttggagttagtagtttagaaatttagtatgtggagttgaatatgattattttgggaatgattagtaaaaggaaggtaaggtgcgatgataaaagatttaagttgagataattggggagataaaatttggattaggagtgtagatttatgaatattatattgtgtttattgtttatggtttatatggtaattgggatgtatttttagatgtggtgtggtgttattagtgtgattaggtatattagtttatttatcggatatgttgaaagtatttgattttgtgttggatttaaaagtttagagaatgggaattgttttatttttattttattgtatttagtgtgttgtttggtatattagtaggtagttagtaagtatttattaaatgaatgatatatttaattttgttttttattggtagtttgttttggcgtatttttttttatttttattagttaaggtagggttaggtgttttgttttgttttgtttttttatatttttgaggattaatgataaagtatttattttgttggaatgagagtttattaataaattttgtatattataataatagaattattatttaataatttgtttttaataaataaattttaaaataattttttttattattttaaaggtatatatagttatatatataattagtaattaatatttgttagtgtttattttaaaatgtagattagtttttatttagtttgttatttattttaaagttttttttttttcgattttgaatgttgttagttttttttttaattggttatttttttttttaattaatgttgtttagttgtttagatttttattgtgaaatattagttttattaaatttgaaaatattgttatagagtaatatttcgttagattggttttattattttttgaagaatggattatatttattttttatttaatgttatttttttttttatattgtttgagtattattttttttaagaagttatttttgattattttatttttatttttttaggttttttttttaatggtttatattattgattttttatatagtttagttgtttttatgttttttttataaataagtttttatatttttgttttttaatataaataggggttttttagtttgagggagatagtttagggagtattaaaatatacgtagtattaaaaaagtagttttaggttattggagtttattagttattgaatttttgtttttgcgaatttattgttttgaaggttggtgggtagttgtaaattttttgatgtatttgttgtgttgttgtatttttttttttgtttattttttttgcgtatgtattattgtcgttatggttacggtattgagtattagggttgttaggttgtataattttaagggggtgttattcgtaatttgtttgatacgaatggtgttttttggaattatgtattgtaatatttgtacgtgattttgtcgaatattagaaaattttattttagtggtaatggggaggttggtttttggtttgtttaaagaattcgtttttttattgtgtaatattatatattttttaggatatttgataagatatatttaagtatttgttaattttgtattattaaatatgtgtgtttataaagaaatagattattttgaaataaagagaaaacgttggtagtgttttgtggtggtttaatggatggttattatttttttttataagttttattttttttataatggataatgttatacgttatttttttttttttttttttttttttgagagtttgttttgtcgtttaggttggagtgtaatgatatgattttggtttattgtaatttttgtttttcgagtttaagtgatttttttgttttagttttttgagtagttgggattataggtgtgcgttattatatttagttaatttttgtatttttagtagagacggggttttattatgttggttaggttgattttgaatttttgattttatgattcgttcgttttggttttttaaagtgttgagattataggcgtgagttattgtattcggtttaatgttatttttataattagaaaagtagatattttcgattgtgggttttagtattaaaaaaaaaaaagagtagatattatttaaaagaattggttgattgatagagagaaaaatgaaagtggtaaattgtatatttgttagaatgaagttagttagaattttatataagatatgtaattaaagtttttatttatttgattgacgtgaatattttttttggtaaaaagagttattttaggttaggtatagtggtttatttttgtaattttagtattttgggaggttaaggtaggtagatcgtttgagtttaggagttttagattagtcggggtaatatggtaaaattttatttttataaaaattataaaaattagttaggtatggtagtatttgtttgttattttagttattcgggaggttgaggtaagaggattttttaagtttagaaggtagaggttgtagtgagttgtgattatgttattgtattttaatttgggtaatagagggagattatgttttagaaaaaataaataaagagttgttttgttgttatatttgtaataatatattatatttatgagattttaattatgtatattatatgttattaaaattagggtattgtttcgttgtgggttttttttatttaaagaatagtatggatattgttgattataagatttattattattttatgtataattaaggaagaaaaattttgttagttaaattttgatacgttaattaagatatcgtaattttagaaagttttaaatgttaaaaaaaatgtgtatttgagaattaatgaaatatggtgtattttaatgtatttagaaggtgaagtaatgttatataggttagtatttgaaatgttaaatttttgagtttttgatgtataattttgttatgtttgatttttgaatagttatattgtggatgatattataaaagtagaggtagtgtagtttaattgtatgtaaatatgtaaaataaataaaagtgaataatatgatttagttatataacgtttggaaaaaatattagtattaagttacgtgttggattatattataaattaaaaattaattttttttttttttttgagatggagttttatttttgttgtttaggttggagtgtaatagtataataaaaattaattttttgatagttgtttatattgaaaatgtgtgatgataagacgaattaaattttagatgttaatatataagttatttttggagaagttaaattaaatatttagaaaaattttagtagtgtaatagaatgattttatatttgtttcggaaattgaataatagtgtttgttgtttatgaggttattaggaaaagttagttgtggatttttttttagtataattaattgttttcgttgtatataaaattgaaagaattgggtgttttagtgcggaaaaaggatattttgttatattgtttttatttttttataaaggttattattgagttttttattattaattcgtatgtattggattattttgtgatgaaaggttaaaaggttttttatttttatagttttttattttatttatttggtatttttttggagatatttgttttttttttaagattagttaattgttaggatgttagaaggtggttaatgattgattttttttttagagattgtgagtttatttttttgttgttttttggggtggttttttttattgttgagaaatattttgcgttttgttattatttgaggtaaaaaatgttattttttttttttttttttttttttttttttttttttttttttaaagatagagttttgttgtttgttatttaggttggagtgtagtggtgtgattatagtttattgtagttttaattttttgggtttaagtaatttttttattttagttttttaggtagttgggattataggtgtatattgttatatttagttgatttttttgtatttttgtagagatagggtttttttgtattgtttagtttgatttcgaattttgggtttaagtgatttttttattttagttttttaaaatgttgggattataggcgtgagttatcgtgttaggtttaagattttgtttttaaggttgagttgagtaggttagaatttatattagtattgtttaatagaatttttagtgaaaatgaaaatgttttgtattttttttgttttaatatagtagtttttaattttatgtggttattgagtatttgatatggttaaatagagaaattgaattttgatttttatttatttttaattaatttagaatttatatagttatatatgttaagtagttattgtatgtattagttagtgtaggtttatatgaaggatatataaaaaaattatttgatggttttagtgtatataatgggtagggattgaggggttggtattgaaaatgtagtattttagttaagtgtagtggtttacgtttgtaattttaacgttttgggaggttaaggtgggtagattatttgaggttaggagtttaagattaatttggtcgatatggtgaaatttcgtttttattaaaaatataaaaattggttgggtatggtgacgtacgtttgtaattttagttatttgagaggttgaggtaagagaattttttgaatttaggaggtagaggttgtagtgagttaagatcgcgttattgtattttagtttgggtaatagagtgagattttgttttaaaaaaaaaaaaaggaataaagaaaatgaagtatttaaataattaaaagagtagaattggattgtttgtaatataaaggataaatgtttgtggggtggatattttagttttcgtgatgtgattattataattgtatgtttgtattaaaatatgtattttatttaaaatatatatatatatatatttataaaaattaaaattaaaaaaaatgttattttaaaaaagaaaatgggttgggtatggtggtttatatttgtaattttagtattttgggaagttaaggtaggcggattgtttgagttaggagtttgagattagtttaggtgatatagggagattttttttttataaaaaatattaaaaattagttgggtatggtggtatatatttgtagttttagttatttaggaggttaaggagggaggattgtttgagtttaggagtttgagataagtttgcgtaatataggcggattttttttttataaaaaatattaaaaattagttaggtatggtggtatatatttgtagttttaattattgaggaggttgaggtgggaggatcgttggagttagagaggtggaggttgtagtgagttatgttggtattattgtattttagtttggatgatggagtgagaaaaaaaaaaaagaagaataggttttgaaattattggttgaattgatgtttttgttttcgttgttaaaaataaatggtagaaagtttatatatttagggattttttttgtagtttgttattagagaagtttttttaaatatgtagagtattagaaatcggggttgttatttaatggatataaagttgtcgtttatattaagtgtttttattacgatttttttgtttgttttttgagatggagttttattgttatttaggttggagtgtagtgtttcgattttggtttattgtaatttttgtttttagggtttaagcgatttttttgttttagtttttcgagtagtaaggattataggtatatattattacgtttagttaattttgtatttttagtagagatggggtttcgttatgttggttaggttggtttcgatttttgattttaggtgatttatttgttttagttttttaaagtattgagattatagacgtgagttattgtattcggtcgatttttttaaaaaaataaattttttgtttgggtatggtgttttacgtttgtaattttagtattttgggaggtcgaggtaggtggattacgaggttaggagatcgagattattttggttaatatggtgtaattttttttttattaaaaatataaaaattagttgggtatggtggtatgtatttgtagttttagttattcgggaggtaggagaattgtttgaatttgggaggtagaggttgtagtgagttaagattgtattattgtattttagtttgggcgatagagcgagatttttttttaaaaaaaaataaaaataaaaataaaaaaaataatttttttaatggtagaaattagttaaaatgttaagtagcggttgttttttagtagtaggattatggttattttttttttttttttttgtttatgtgtgttttttatattttatttaataagtatatattttttttttaatttgttaatattaaagagagttaaatttatttatttttttattatttaattttaaattaaagtggttttaattaattttttttttaagagagagggtagttattttgaaatattgtttttttaaaaattattttaggtagtaattttagttgagagatttgtattttttattttagcgtgaatagtattagagatttgtgtttgggatgttttagaattttgttgagaagaattagagaatatttttttggaagatatggttgtagatttggagttatttttttatttaggtattttttgggtgttgtgttaggatttaagtatttttggattatatttcggagttttagagttaaggtttaatagtttaaggaggttcgtggattgataagggttttggttttaatattgagaagagaattataaaaagaagtttttattttttaaaagtttatatatgatcgtataggtttaattgggaatagcgagttgtttatagtaaagtataaattgtataaagtagattttagcggatatttttagaggatgttttgtgaatttttatttttttaagtttagatttagtagagttggtttggtgaggtagggcgttgtaatgttagttagaggagtagtttagaaatttttttttagaattttttttgattaaaagagatggttaaagagtttttttttttttgaaatttgaggttaattttattatttttttaattgtttttgtatatttattaaagagatttttgagaaataggtttagttatatgatgtggtgggaagaatacgaattttgtaattagaattttggttgtattttttagttttttattttgggtagagtttgttagttttttagatttttagtttttttatttataaaatgggaataaataatattaattttatgggatagatgttagaattaattgagatatatgtaaagtgattgttatagagttagtatttaatgaattttagttattttttttttttttttagaaagtgattggtttattagtgtttgtgttgaaggggagagaaaataaattgtaaaattttaaatgagttttattttaaatatagtttaatgtagtttagtaattagtatatgagttttgttttagtttgggttgggttttagttttttattttagttttagttttggaatttttttttttagaaaattttggcggtttatttttaggtcgggttagcggtttgttgagttgttttgtagtatttatttggttttcggttttttaaatcgaggtatttaatattgaatgtggagtataaaaggttatagagtaggtcgggcgaggtggtttacgtttgtaattttagtattttgggaggttaaggcgggcggattacgaggttaggagattgagattattttggttaatacggtgaaattttttttttattaaaaatataaaaaaattagttaggcgtggtggcgggtgtttgtagttttagttatttgggaggttgaggtaggagaatcgtttgaattcgggaggtggaggttgtagtgagttgagagtacgttattgtattttagtttgggcgatagatttagatatcg

SEQ ID NO: 25 - DNA, 29256 bp, Artificial Sequence
  chemically treated genomic DNA (Homo sapiens)
acgtgaaattaaagataaattaaggagttaagttttaaagaattagtataagttgtttttttagtaaagaaattaaagaattaatttgaagtagaaagaaattttttgaatttgtaatgtttttttagttttaaatttttattttttggtttttggttttacgattgtttatatattttaaatattataaatgttaagtgtaaatataattttatataaagttttattgtatagaaaatagagtatggttaatttaagggggttatttattttatttgatttattatttattttgggggttggttttaatatgtgtagtgtatgtttgaatgttttgtgttaattttattgataatttttgttgggattagggaatattgtgaataagtaagtagaaaatgagggttgggtgtggtggtttatatttgtaattttagtattttgggatgtcgaggtgagtggattatttgaggttaggagttcgagattagtttaattaatatggtgaaattttatttttattaaaaatataaaattagttaggtatggtggtgtatatttgtaattttagttatttaggaggttaaggtaggagaattgtttgaatttaggaggtagaagttgtagtgagttgagattatgttattttattttagtttgggtaataagagtgaattattgttttaaaaaaaaaaaaaaaaaaaaaaaaaaatgagatttgttattatttgtaagatttgtggttagtttggtattatattttttatatgttagaaaatatgttttaataaatatttgtgaatgaatagttattttatttgttatgttttttattttaatagagaattattagattaaattttttatttttttgatttataagatttcgggtatatttaaaaaaaaataatatatttagaagttttaagttcgttgttgaaataagtattggaaaaaataagtgtgttattaagtattatttatttataaatgttaatatttttatttttaagtaattttgaatgtagttttttaattagaaatttaatataaatgaaaaatttttttttatagtttattttgaatcgttgtatttatagaggtagttgtttagttttaattaatggtacgggaaaaataataggaaaaaaatcgaaattgtatgttttttaatgtgatagttttaaattgatggagtaagttttttagagaaagtatttttaaagtgtattattggttgaggtaagaatgttgttattgttttttttttttttttttttttgtttgtagttaaattaagatttgagaaataaggttttattaaatagttgttttagaatttttagttttattaaagtttagatataaattatatttaaaagtttttataatgaaaagttttttataaatatcgtgggggttgatttaattattagaataaagaagattatattagtgaagtaaagaattttttaaattttttataattaggagaaattagtaattggtaaatatatatatatagatatatttattataattaattattattattgttattattaataataaattgtaaattacgattacgattgtgaaaaaagtaaaattaacgttaaagtttttattggtttaaggtgtattgttgatagtatttagttagtaaagttttataattatgatatttatttagattgttatgttaaagaaaaggggtttttattttattttttgggagtttttttttttttcgttatcggttaatttttgtttagtatgttttttttattttgttttatttttttttatttcgaggtgttcgaagagtatgattttagagggagttatttagtaagtgttttttagttttagttttttttattttgtagtttttatgatttaataagaagttgtgtatataatttttaatttatagtaaattgagtttttgtagaaggattttaattttttttttagaagttttaggataatttttgttgtttttttgtagttttttttaaagaatttatagtttggtttatacgggagtatattttgttttgatttttttgtattggtttttttaaagttagagaatagaattttttatagcgttaggtatttatttaatgtaaaaaatattgtagaattgattttttttttattttttgtttttttttaattgttttttcgggattatatttattatgttaatgagttgtattttagatatttgtgaaaagatcgattaatttagttggttgtattttaaaagttttagagtttgttaatcgagattagtttaaggtttttgaaaatatatttgttttaaagattaaagattaaaaattgttataatttgttttggtttaatagtggtttagagtgtaggttttggaataataatgttaatttcgggagtttggagtcgttatcgatagaagatttagtgtaagttatttaatttttttattgtttgttattttttatatgtgttaagtgtttggaagagtatttgttttataataagtttttaattatttggagtaaatgtaagaaaatttaaaagttagattttttgttagtttttacggttatagaagggttttattatgaattaagttgataggagttaaaggaatttttttaagttatttgtatatgaaaaatgggatttttagtggtttttattttttttattttaaattttaaaatatagttgaaatcgtttatgttaataaaattttacgaaatattttatatgttgaagagtgattaaaagaatttgtttttaagaaaaataaatttatttttttttttattttttttttttatttattttttttttttaattttaaatttaaaaaattataaagattgacgtattaattgtttagaaaaagtagaattttttatatttcggggtgattaaattttatttttggtttcggaggattggtagagagattcgatttaattattaagtcggggttgtaaaaaagttagtttattagggtattttatttaagtatatttgggaagtaggggtttttaatttatattatagatcgttagaagtaaggataagataaattagattatttgggggttgaaaaaaacgacggtcgaatatttaatttgcgaaatttggtagtggatttgaataaatttatagtcggggaagttagttaaattggtttgggaaagggaatagtagaaatttcgtagtggtagttgacggttataagacgttattttatatgagtaaaaatgtttgttataaggtgttcggttgtaggcgatcgaaggcgtagtgatggagaattgacgcgggtgatttgttttttttaatattatatatttttttcgatggttgatgtagtgtttttttgggagtattttttgttagttcggttagacggttttttaaggtgttaggagggttcgaatttgagtgcggttttttcgtattttcgcgttcggggttaacgatggtttgggagtgtgggtattgttttcgaggttaggggtaggaggattggtggtttagaagtagaggggtttgcgggagagaagagaatagaaaatttcgtagacgcgcggtggttttttttttcggcgtttgttcgtcgttttcggtcggaggttagtaaggttagtaggatttatttttcgtttgcgttgtggtcgcggagttttaagcgagtcgtgttagtttcgcggttggttagcgagggggcgagcggcggacgtagcgcggttcgagtttttcgagttagttattttgggttgcgttttttacgtttatttttttttagacggggcgagtgggcgtcgtttggtattgaagttgtagcgcgtttatttgtattggtcgaatttggcgtatattgtttattcggtggggtcgttttcgtaggtttttatgatggtttgtattttttttatattgattttatcgtcggtaaagagttggtgtaggatgcggattagattagttagggttcgtggttttagtatttcggtttgttttatttcgtggggagttggttgcgcgcgcgttttattgttgggttgcggtggaggagttgagcgagttaaggagttgggggcgagggagtttaatagttcgttagatcgttaagtagatatatacgtataaatttagtattagagtgtcgaaacgtaaggatgtcgtcgtagagatagtaagagatttatttttaggtttttggtagcgtagtggattcgggatcgttggagacgcggtgtatatataaattaggtttagatttgtggggtttattttttcgggttttttttaagcgtttggagttattaggaatgtattaacggttttcggagggaggacgaggcggagagttatttaagaaaggtggcggaggcggggagattttgcgggtacggtttacgcgtatattttcggttttttcgggtttcgcgtttttttaagagtttcgttgttttcggcgttttagggatcgcgtgggtttcgcgtaattttttttttattttaacggcgcgttttagtcgttcggtttaacgttttttttcgttttattttcgtcgttgtggttcgcgacgttgggacgtagataaaaagggtcggaggagatggttgcggggattgacgttgagtaaaggaggaaaagaaaagggaaggagagggatattttttttaaatagagaattgtgaggagtttgcgaaaattgaggatggattttatttttaggttagagagtgtttgttttgtcgattgaaattatttacgatatgttttaggttaggtgaaaataagtttaagattttatatatatatatatttaagtatatatatatatatattttttaaaatgcgtattgaaatatattttgataaaggagattcgggtttttagtaagataattagtgaaatgatggaaaattaagaattttttgattttaaaattaaatatttttttttaaaaaatatttagtgtaaataatttgatattttatttgatggtgtaaaagggggttttttttgaggggatagggcgggttttgacgtaataatttaagaggttataattatatttgaattttttaattttaggtatgtgtttgaaggagtttgttagtatatatatataaggaaatacgtttttacgttatgtatagtatttagtacgttgggaataatataaattaagtatagtaggatttaaatgagaaagatgtgaaaggtggaagaaatgtaagtgtagatttttttttttttattatggatggacgtagggaataatttggatttaaggttattaaagttttagatttttgaagatttgtttttttttagattatgattattttttttcgtgtatatatatgtatataatgaaatttatttgtgttaggtagttttaaatatttttggtaaaattcgttatattatattttaatagtgttgttaaaagcggaattatttattgtttaaaaatggttataagtagaaagtattttagaagttagttttggtgatgtgtgttgttgcggggtagtgaattaataaagtattttgtgatagagtaatttgtaaattttttatggtttttttaaattattttttatttttggtaatgttttttattgagttttttaattattttattttagttagtttaatttataaatgtttggaatgaataataaaaatgaaatgtaagtataatttattttttttgtattttagttgataaaatttttaaatttttttgataatttattttttttttttgatttttttttttttttttatatttttatgaaagtaatatatttacgtagttaaaaaaaattaatagtattggaaggttaatgaaaagtagtaggtttttttaattatttttgattatttgttttgtgtttaaagagttagttttttaatttttttaattattttttgtggtagttattttttttttttaaaaataggtttatatttttttttgttttagtaattttagatattatttagttattttatattatgatagttttattcgtttattatttatttattaatttatttaataaatgttttttcgggtgaatagaaatttttattttatttgagtaaatatttaggagtgagattgttgggttatttagttagtgtatgtttaaatttgtaagaaattgatatattaatttgtaaagggtttgtgttattttatatttttaatagtgatgtatgagttttagttgtttcgtattttcgttaggtattgttagttttattaattttggttaaatagaggtgtgttgatattgtattgtgttttttattttttatatttttaatttttatgggtaggtttttgtttttagagtttttaagatggtggttatcgtttttaggatggtagtaagttttttgttttttgaattggggtttttggttttatggattttaaggaatggaattttggattatgcggtgagtgttatagttttattagaagtcgtgggttatagaagagaatcgtggaatttagttattagtgtttagtttaaataggacgaattcgggtatttagttatgtaggaataatggtaagtttttagtcggatcgggagtggtaatgggtgtttcgttggattagtaaagtagcggatattttgtcggatttggaggggtggaagtcggtggcgggtttgtgatagtggtaaatagtagtggtgaaaagcgagcgaaagtttagttcgagttataataaatatagattagaagagtgtgtagttgttagatttaatagagtgaaaatatagtttttatataatgcgacggtacgtaaagagggttgttattttttgttttaatgtttgggtttatattcggattattgttttttttttatgtttttaggcgatatattatttgattatttttttattttttgttttagtttaatttgtattttagtgagttttttttattgtttgattggttgggtgtgagttgagttataagtttcgtgtttaaaagtagttgtagttattttttttagttagggtttaggaatttttagtcggtttaggaaatttagtttgttttgttttttataatgattaatgatgttgagtatatttttatgtgattagttatttgtaaataatttttggtgaaatatttaagtattttgtttttttaaaaatttaattatttgtttttattgttgagttttaagagtttattatatattttagaaataagttagatgtgtgatttgtatatatttttttttagtttgtgattggttttttgtttgtttttttggataaaggttttgttgtgttattgaggttggagtgtagtggagttattggtttattgtagtttttaatatttgagtttaggtaagtttattgtttacgtttattgagtggtagggattataggcgtgtattattatatttggttgattttttatttttttgtagagatgtggttttgttatgttgtataggttgggtttgaattattaggtttaagtgatttttttgttttagttttttgaagtgttgagattataggtatgagttattgtatttattttttttttaattttttagatttaggggttatatgtgtaggttatttgggtatattgtgtgatgttgaggtttttggtataaatgttattgttatttaggtattgagtatagtatttaatagttttaatttttttttttttttattttttttttagttatttttagtgtttattgttgttatttttatgtttatttgattttattttttgatttttaaagattttaaggaatttttttaatatattgatattgatatatttttattgtttttttttttaattttttttttttttttatatttaggattttattgattgtttgtatgtggatgttatttatatttttttagttttatatgtagattgtaatttttaatattttttggtattttcgatgtagtatgtgtgaaattttttttaagaatgtttttttaaatttttaaaggttttatttttgtaatgaggtatttaggtttaaaaattttatttattgttgtttattttttttttgtattattatttagattttatttaattaattgttaagttttgtatttttttattattttttttattttgtatttttattgttattttattatttaaatttttatttgattttggttggattatggtattggtttttgaaatggattttttggttttagtttttttttatatgtattttttatttataattgtttgattttttagtttaaagtatagaattgatgatgttgttttttggttatatttttttaataattttaatttttttatataataggttttattaggttggtattaattttttttttatattttggttgtaaattattttttttgatatttcgttttttattatttttttttatgaatatattttttagttaaattgaatgtgtttattaaatttatttttttgtttaagtttttttttttgtttaaattttagttagttattttaatatgttttaattttattttaagatttagtttttatttttttgttaaatgtgttattttttttttttttgaataatggaataattattattttttttaaggtatttattattttttagtatgtattgtaattatttacgtggattattttgatagtgagaatttttaagataggttttttttaaattttatttttatattattattagggtttagtatatagtattttgtgtaggttaggtataaatagaaatattttttaagtgtatgtataaatgaaattagtaaaagtatattggttagagttttttaatattagagttattggttagtaaaagtattcgtttagttttttatttttttttaaggattttagggttgtgattttaaatttagaaaagattttttttaggttttttgtaaaggatatttgaattttttttaatagtgttgtatattgtaatttaaatgtagttattaaaaaaagttgatattatagattttattaatataagtagaatatttagatttagagaggtagttttattgtattttgaattgtttagggtaattaatgattgttatatttttagataggtattgatatggtggtagatataaagagaagggaattatttaatatattttaaaaagtatgtattatatgttaggtattgttaataaaattaagttattgtttttagagggtttatattttaatggggttgggttggtaggaggagtatattaataaatattgtatatagtatatatggagaaatggatatataaatatttgataaaatatataatggagaaaaataaaataggggaagttgggtaagtagagtggcgagttgttgttttagagggagtttaggggaatatttttttgaggtggtatttgagcgaggattgaaggatattagtaagatatttgtttagggtaagtttttaggtggaagaattagtaagtgtaatagttttgggattgtagaaagtttagtgtttgagtaatagtatttgggtggtagagtgtggggaagtgatgattatatattatataggttaaggtaaagattttagtttttatattaatatagaaagttattggggattttaggcgaggagagagtatatatagaggaattaacgagttagttgttgtaatttgagtgaaaaaaaattatgatggtggttttgtttatagtggtagtagataagaaatggttggattttgaatatgttttgtaggtaaattagttaggtttttaaatttttatggatatataaatgtatatatatatggggtatatgtgaaattttgatataagtatataatatgtaatgattaaataaaggtaattgaaatatttattattttaagtattttttattttttgtgttatgaatattttaattttatttttttagttattttttgaagtatatattattaattatagttatttaattgtgttatttaatattagatttttttttttttaattgtgtattttttttatttattaattaattttttattatttttttttttttattattttttttagtttttggtaattattatttatattgtatttttataaaagtaattttattttaagttttgtgatagaagtgttgaacgtgtaggtttgttaaataggtatatatgtgttatagtggtttgttatatttattaatttattatttaggttttaatttttatacgtattaggtatttgttttaatgttttttttttttttgtttttaatttatttataggtttcggtgtgtgatgtttttttttttgtgtttatgtgtttttattgtttattttttatttatgagtgagaatatgacgtgtttggttttttattatagtgttagtttgttgaggatgatggtttttagttttatttatgtttttgtaaaggatataaatttatttttttttatggttgtatagtattttatggtgtatatgtgttatattttttttatttagtttattattgatggaaatttgggttggttttaagtttttggtattgtgaatagtgttgtaataaatataagtgtgcgtgtatttttatagtagaatgatttataattttttgggtatatatttagtaattggattgttgggttaaatggtatttttggttttagatttttgaggaattatcgtattgttttttataatggttgaattaatttatatttttattaatagtgtaaaagtgtttttattttttcgtatttttattagtatttgttgtttttaggtttttttaatgattgttattttaattggtgtgagatgttagtttattgtggttttgatttgtatttttttaattgattagtgatgattagtttttttttatgttttttggttgtatatatatttttttttgagaagtgtttgtttatattttttgtttattttttgatggggttgattttttttgtaaatttgtttaagttttttgtagattttggatattggatttttattaaatggatagattggaaaaatttttttttattttgtaggttgtttgtttattttgatgatagttttttttgttgagtagaagttttttaatttaattagattttatttgttaattttggattttgttgtaattgtttttggtgttttagttatgaagtttttgtttatgtttatgttttgaatggtattgtttaggtttttttaagggtttttatagttttaggttttatattttagtttttagtttattttaatttttgtataaggtgtaaggaaggggtttagtttttgttttttaaatatggcgagttagtttttttagtattattattatttattaaatagggagttttttttttattgtttttttttgttaggtttgttgaagattagatggttgtagatgtgtggtgttatttttgaggtttttgttttgttttattggtgtatatatttgttttggtattagtattatgttgttttgggtattgtagtttttgtagtatagtttgatattaggtagtgtgatgtttttagttttgttttttttgtttaggattgttttggttatacgggtttttttttgggtttatatgatatttaaagtagtttttttttagttatgtgaagaaagttaatggcggtttgatgggaatagtattgaatttataaattatttggggtaatatggttatttttatgatatggattttttttatttatgagtatggaattttttttaatttgtttgtgtttttttttatttttttgagtagggggttttgaaggttttttatgttttttgtaaggtgtatttttaggtatttttttttttttttgagacggagttttattttgtcgtttaggttggagtgtagtggtacgatttgagtttatattgtaagttttgttttttgggtttatattatttttttgttttagtttttcgagtagttgggattataggtgtttattattatatttagttaattttttttatttttttatttttagtagagatggggttttattatgttagttaggatggtttcgattttttgatttcgtgatttgtttatttcggttttttaaagtgttgggattataggtaagagttatcgtgtttagttaggtattttttttgtagtaattgtgaatgggagtttatttatgatttggttgtttgtttttattggtgtataggaatgtttgtgatttttgtatattgatttttagttttgaatatttttgttaattttttgttttgttgatttaatattgatagtggtgtgttaaaattttttattattattgtgtgggagtttaagttattttgtatgtttttaagaatttgttttatgaatttgggtgtatttgtattgggtgtatatatatttaggatagttagttttttttgttgtattgatttttttattacgatataatgtttttgttttttttgaattttgttggtttaaagtttgttgtattagagattaggattgtaatttttgtttttttgttgttgttgttgttttttatttgtttggtaaatatttttttattttattattttgagtttgtgtgtgtttttgtatgggagatgggttttttgaatatagtatattgatgggttttgattttttatttaatttgttagtgtatgttttttaattggggtatttagtttatttatatttaaggttaatattgttacgtgtgaatttgattttgttattatgatgttagttggttattttgtatattagttgatgtaatttttttatagtgttattggtttttatattttgatatgtttttgtagtggttggtattggttttttttttttatattttgtgttttttttaggagtttttgtaaggtaggtttggtggtgataaaaattttttagtatttgtttgtttgtaaaggattttatttattttttatttgtgaaagttagtttggttgtatatgaaattttgggttgaaaattttttaatagtgttgaatattggtttttatttttttcgggtttatagggtttttgtagagatttattgttagtttgatggtttttttttgtaggttatttgatttttttttttgttgtttttaatattttttttttattttaattttggagattgtggtaattatgtgttttggggttgttttttttaaagagtatttttgtggtggtttttgtattttttgaatttgaatgttggtttgttttgttacgttggggaagtttttttcgataatattttgaagagtgttttttaatttggttatattttttttattatttttagggattttagttaatcgtaggtttggtttttttatatagttttatattttttggaggttttgtttatttcgttttaatttttttttttaattttttttttacgttttattttagtaagttgatttttaatttttgatatttttttttttattgattaattcggttatcgatgtgtgaaaagaatttttgtagttagttcggtgtttgtttgaatagttgtttagttttgtttttgaaatttagagttttgggggtgtaggtatatgagggaattttttggtttgtggatttttaaaattaggggaaaagtgtggtatttgggttagataatatagttttttatagttttttttggttgggaaaagtaggtttttttgttttttttattttttgtatgaggcgatattttattttgtttttgtttattttttttggttttatttattgtttatttagttttaatgagatgaataggatattttagttggaaatgtagaaattatttatttttgtatttattttatttggagttgtagattggagttgtttttatttggttattttgttagttaattttaaaagtattttttttttaggtttttatatatgagagtatgtgttatttgtttttttgtgtttggttttttttatttaatattataatattttttagttttatgttgtaaataataggattttatttttttttagggtttaagatgatattatgtatattttttttatttattgatttatgtatggatttttaggttgattatgtattttggttattgtgtatattgttgtaatgtaggtatttcgatatatagatttttttatttttgggtttataattagtagtgagaatgttggattatatagtagtttttttttttattttttgaggaaattttatatttttttttttagtagttttagttatttatatttttattaatagtgtataagtattttttttttatatttttattagtatttattattgtttgttttttggataagttatttaaattggggtgtgatagtttatttagttttgatttgtatttttttggtgattagtgatgttgagtatttttttatatatttgttgttcgttttgatattttttaagaaatatttatttagattttttgtttatttttaatttttttttgttattaagttttttatatattcgtttttaattttttgttagatgagtagtttgtaaatatttttgtttattttgtagtatatttttttattttgttttttttgttgtgtagttttttagtttgatgttattttatttgtttatttttatattggttgtgtttttgaggttttataagaaatttttgtttagtttaaatttttggtttttttaattttttttttataattttaagttttatatttaagtttttaatttattttgatttttgtatatggtgagagaggggtttaattttatttttttgtatttggatatttagttttgtttgtattatttattatagaagagattgttttttttttaatgtatgtttttagtgtttttgttaaaagagttgattgtaagtaaatatatggatttatttttgggttttttattttgtttttttggtttgtgttttgtttttatgtttttattatgttgtttttgttattatagttttgtagtatataatttgaggtttagtaatgtgatgtttttggttttgttatttttgtttaggatggttttggttgttttgggttttttgtggttttatataaattttagatttttttttttttatgttagtgaagaatgttattggtattttggtagtaattgtattgaatttgtagattgttttgggtagtaaagttgatggattgaaattgggttggaagagagttaagattttaagtaattatagggatggatttattatttttaagataagatttgggaaaagtggggtaggaaagggggaaaggtatgttttgtagatgtagataaaagaattgggaataaatatttggaggaagtaaggaggtagattttgttatgttgtaagaaaggtagttatgaaataaatagagttattttaaaatggataggatattttttttgtttattattagaagtaattaatttagatttatgtgtattagttatgatagaaggaattatgggaattgatttataaggatttttttaaagattttatttacgttttattttttattaatattaaatacgaaaatatgggtatagtagttagtattaggtattaaattattttttattatttttaaaaattttattttaaaaattttcgagatttaaatttaaatttgaaaatttgttttatttttttgagttaatatgaaagtgattttaagaatagggattttattagttttttatgagttttattagtgttattttaatatttaggatatagtaggtatttaatatgtgaatgataggttatacgaataaattgaagtttatatttacgttttaaggtttttgatattgttaaatggttttttaaaagtgatatattaatttatattttatttattaaaatatgataggatttttttataattttgttaatagtaagatgtatattatttttattgttagttagtattgtttttatttgtattttttgtaattaatggggtttaaggtgttttatgttttgttggttatttgtatttttttgtgaatcgaaatttggtatgttttgtttattttttagttggtttttttttattaattgaaataaattttttatatatttaagatattaaaaatattgttatatgttgtaaatattttttattattttttgttgtataaaaatttaaattatataaaattttttttgtttttagttgttatattttgttaattataattttatttattcgatgtgttatattattaattatttatatataaggaaatgtattaagtattatgtgtgtgtgggtattagataaaaattagaataattggatatatggttttgaggtagtatgtaataagtgatttaatagtggtagtttgttttaagtgtttttatgagagaaagggtattttttttttgaatgatttagatagtttttaaaaagttaaaatttgaattaggttttgaagaagagttaggatttgaaagggtgaaggtgtaagtaaattgtacgagtagaagtagataatagaaaatataaggtatttttaaagaatggtgaataatttagtttgggttaaataatgtaggtagagtatttatataaatacgatttgaattgtatttaaatagtagtatttgttgaattgttttttgaatagtttttattacgtggtttgtagttggtttttttagtgttaaaagtttatttagtatattataatttttggaaaatgaagtagaaattgtatgaaaagagatttttatttttatatttttttaatatttaaggtttttttattttgtgttataattaaattggttgattaatgttatgtaatttgagaaatatattgtatttcgttttagtagatatttaaggtttttttaggattgaaatttatagaaattagattttaggaattatttaattttattttgatttcggataaatattaatttgttttattttttaaatatggtgaatttattatgaagtttttggtatatttttaaagatggaagtataatattgtaatattatatatatattttgtgtgttatgggttatttatgtatagtaagatgaagtatgatattaatgatatttatttagttataaagaaaatttaaaatattatttgaatgtttagttttttttttaagtttaattagatttgagagtttaaattaaaaataaattgtgttgtaggttttagttatttaataatttatcggatttaggtttaattattgtttaatgttgtaaatttagcgtagaataattttttgagtaaagattaagaaataattaaatatgatttgaaaaagtataaagtttaggttcggtacggtggtttatatttataattttagtattttgggaggttaaggcgggtggattatttgaggttagttaggagtttgagattagtttggttaaaatggtaaaattttgtttttattaaaaataataaaaaattaggcgggtgtggtggtaggtgtttgtaattttagttatttaggaggttgaggtaggagaattatttgaattcgggaggtagaggttgtaatgagttaagattgtgttattatagtttagtttgggtaataagatcgaaacgttgtttttttaaaaaaaaaaaaaaaaaaaaaaagtgtaaagttttatgtattttttagagttgttaggaaagaaaataaataaggttagttatatatttagttaattttagatttaataaattattaagttatttaggttaaaaagaataattaaatggatgttataaattttaattagtattttcgattttttgaggtttattatttgaatttttagtggtaaataatacgaaaatttaatatatttttatttgttaaatatatgaatataattaaatatatttttttagtaaattgaattggataaaattagagaatagattttttttatatttatttaattttaaaatgatattattttgaattttattatatattattttagattttgttttgaaattttatttatattatattcgatttattagaatgttttttttttttttttttgagatggggttttattttgttgtttagtaggaatgtagtggtataattacgatttattatatttttgaatttttgggtttaggggatttttttgtttttgtagtttaataatttttttttaatttttatttttttgtagagttggggattttgttttgttaattaggttggttttaaatttgtggttttacgtaatttttatattttagttttttaaagtgttgggattataggtgtaagttattatgtttgatttggaatgttttttaaaaatatggtattataaatataatattaaagagaaaaaaaggttaaattttattttaagaaattattagtttaatagtattagtaaaaatggtatttttagttatggtataaaatatataataaggttattttttaattattgtttttaagttggaaaatgtattatgaaatatttaaaaagatgttattgggtttatttattaagtgtttttgatattatataaatgatagagtaatattatagttatgtgattgggatttaagaatttttaaatgttaggattgaaaataggtatatgatttatttgtttagaatttatatttttttgtattttaataaaataattaagttatgtgtattgtgtaaaattatagttttttagtttgttttatgtgtttgtttttttggttagatattagttaaaaattagtaaaaatagttattttttttattattttttagtaaagatgtgaaattaaaacgtttaattttttttgtttggtggattgttttttattggattatttgaggtatttagttagtaggttaatgtgattaaaaaggtaaatatagagataaatgtaaatattaaaaaaaaaggaattttttagtatattaatttttattatgaaaataattttagttattttgagaattgataatgaagatgtttatatagttttagttttttttttaattttggaggtagatttgtagtaataatagtaataagtaggagtaatgggtgtattattatgattattttttatgatgattggtgtattaatataaattatatttttttgagtttatttatgttatggatgtttttttatgtataaatatagagtagatatatattaaatagattatatttgttaagttttttgttataagtattaaaattttttagagttgtttttttcgtgaaaatttattttatgtagtagtaagttgattttttttgtggtttatttttacgtttgagatttgtagtaatgtaaaattagtttattattattgttaaaatattataaaaaaaaaaggtaataaattaaatttaattttttattatttttagatgaaattaagaagataaatgttatatgtattataaatatttatatacgtatattaagttatttatgttataggttattttttttaaaggatgtttgtttttattagatatatattaataattttaagtgtttaataaaatttgttttttaagtattttaggtatgaatgagtttatgtattttaattttgttttttttttatatgtttaattataatatatgtaattttagttgttttttagtagtggtgttagtatgtgtattttaataattattataatgattttgtaagatgttaaatagttatttttatgttgtttttttaattttttgtaggtagatttggataatagattataagaataatgtagaagaaattaaatgtagataaagaaaaagttttattttatgagaattatgaagatgattttgaaatgtaatttattttttggttttttaattattgtataatttattaatatttttttatgattaagatgttagataatagaataagaaagttattttttttattttagaaaattaagaatggtatgttattttttgaaataaaaatgtgaattaataatattatataatatatatattatatagatgtgtatattcgattaagaaaaaaaagtagtaattttttttttttttttttttttttttttttttttttattttatagagagttttaattttttggtttggggaaggagtaaaggattgatttatataaataaattataagaaaggaaggaaaaatagagatgtttaatggtattttgattaatttgtatttttttgtattttaattagttagttattttgtattgtttttataattgaagaaagtttttttgaatttttaatttttttaaatagttaatttaaagagattattacgaagattttattttttttttagaggaataaaaataatataattttagtttttagaatagtggtttttaattttgtataattaagaaatttttaaatattttttataaatagtttttgaagagttggttatttaagaaattatattatcgtaaaaatgtttttatttatttataaagaattttttttaagataattatataggtatatagttaaaaattaatatgtttaatatttaaggtagtttgtatattttttttgggtaaatgtatgatatatatatttaggttttttaataaagttatttataggtaaatgaagtaggaaaaaaagtaataattaaaattttataattttgttttttaaaggatttattgtttaatgttttagtttagtttgtttttattaaaatatttttagtatttaaagttatagtgttgaagtgttttttaataattttttttttggaaaataaaattttatttgtaggtaatatatttagtttttttttaatatttaaatttgggattaaaatgttttggattaaatttagtatttaaaaaaaaaagtattagaatagttggttgatagatattattttgattattaattatgaattattaatattgtttgtattttttttagttaatatagtgtggtgattaagtgtataggttttgagatatatttgggtttgaattttggttttataaataattttttattttttttatttgtaagatatggaaaataataggatttatattttttgggtttgttaggaaagataaaatgagataatatattaatttttagtgtttggtatatgtatttaatagacgttattgttaaattatttttaaatagtttatgttgaaatattaatttgtggttatggttgagtagagttttggtataaaaattttagaattgtaatagaaaataatgtgtattataatgtgaattttttgtaatatagatataatttgtgtttagtgtttgataatttatgagtaaatttagattttatttttgtatattataaatgaggggaagggtttttaataatagtttagtttattagtgtttatgatgtgttgagaattgtatatggaattatgaagattaatgtgatttttttttttaatgagtttataatttgtaggagaggtagagatatatatgaataaatacgggtgagaaaagtatatttaatgaagtatgtagcgtatagaaatgtatattattttagtttagtaaaagggttagtgatggttttgtgggaaataagaaataagtaggatttaattaggtgaagaaagtagtaattaggattttataggtaaaggagataaagagtaagatggtgttgtgtttatagaaaatagtagattcgatggagtagagaattaattaaaggtatttaatgtgattttgtaataggtgttaattggaaattttaaaaaagtaatttagttagtttaaaagatagaaagatataaatttgtttgtatattataaagttttatataagtaataggttaatattattaattttattgtagaatcgttaagtggcgtataatttgttattttaaagtatatgtagttattttaggtttgtgaaagtaaaattttatggaagtattatttttaaattgtaagaatttgggtagataaaattagttagttttattaattattttgtttttaaattagtttttttttttttttgtttttaaattagtagtttttaaattgatgtttttagttattttggttataaagttttttgtttagtggattttttatggtttattggaatagtattttttgttaatagtttgtgtttcgattaagttagttatgtaggatatgaaagttttattttatattttttttttaagtatttttgttgttaaagtttgacgatagtttaattttttaagttatgttttttttttcgttttttatatttttaaatgattttaagtttagtaattttaatagaatgtattttgatgtttattattttgggttgatatttttaggtattttagatgtttttttaatatgtagttttaaattttttattttaaatgatatttttatagtattttttttgtttttttgttttggttttttttatagatttttgtttaaaggttgatttattttttaaattttttttattttttattttttttaatatattattcgttgtttatgttttttttattttagtttttatttttgaaataatttttttttatttttaattttttttttgagttttattttttagttttattaatgttgatcgttttttttttatgttttatattattttattgtttttagtttattttgaaatataaggttataattttcgatttgttttataggtgtatatttttggtttgattttatcgtttttagggatgttgttttttttcgtatttcgttttttttgtaatattgtacgggatttgattttgttatttttgttattgtttttatgtgaaattagttttttttaatttttagaatgaggtgaattagggtagtttttttaattttatagagttttttttgttgttttttgtatattatttaaaacgatggaggtttgttttgagttttttaggttttgttttttattattttgatttggtttttttttttttttttttttttatgtttttattttttttaatttttattttattttttgaaatttttttttagtatggggttttagagtttttttgggtttattttgagattgtttgagttttttaagtttttagtgtaaatgtattgttattacgtgttatagaagagggtaaaattttttagttagtttttatttttaaattggtttattttatttttcggttaggatttattagcgtttttgaggttttattttttttagtgtcgttagatgttaattttgttttttattgttttttttagtatagatgttgatattatgtaggttttgtggttgttggtggtttgtttttattaatatgtgttttggggtttatggggatattttattatttagttttgttataaatattaattaggggtttttggttttgttatttagttgattaagttttgtgagaattttagagagatttacgtgtattttttgattttattatttttttagaatttttagtattatttttttttttttaatatttattttgttagataaaatttaggaggtattagttttagtttaatttaggaaaatgataaaataatttttatgttttttattgtttaaatgggaaaggataattatatttattatagaggatttaatttaatttttatgaaattgtttttatagggtaaaatggttgaatgatggtaattttatatggtttaatttattatgtattggtattaattaagtttttttaggttattgaatgaatataggtaatataaaattttaagatttttaatatagaatatagtattattttattttttttaaatttttatgtatttttaaattaatgtattaaattatttagtatttttattttattaattttttatgttgtatttttagtaaagatgtagtttttgtttattttttttaagtgtatgtttttatttttttgatttttttatttagttttatttttgtgagagtatttgtagttaaatttttagattagagttagttttttgtttttttttgataaaaagaaattttaatatgttttgttttaatgatagtttatttgttttatttatgtatacgtttgtgtttagaagtaaatattttttttagtgtttttaaaaatttttgattttatttaaaaaatatttagtaattttttaattatttatttatttatgttatttgagttaatattatttaagattgtgatttatttgtagataaaggtgttttatatatataattatgtatatataaaaaatatttaatgtgttaaatatatgtagatatttaaatttttgtagttaaatgttaaattaaaatgtagtggtatttaaagaattaatttttattataattgttattgtgaagtgtttaacgtgtattgttaatatgaagtattttttagtttttttataatatatggtaaagatatattgtttattttaagaaaaataggaaaaaagtaattgttattaaaataaattgaaaaaatttaaaatttttgtagtaatgtatagatattgtaatgttttatgatagatttttatgtatgggtatttatgtatatttttatgtgattttttgaggaaaataatataggaggtaaaaaataaatatataaattggtttatattgtaaaataaatttaaaatattttattttagaattttttagagaattttttgataaagtatataaattttattaataagagataaggtagggtatagtggtatatttatgtaattttagtatttttgaggcggtttcgtttttattaaaaatataaaaattagttaggtttggtggtgtatttttgtaataattttggttattagggtggttgaggtaggagaatcgtttgaattaggaggagaaggttgtagtgtgttattgtattttagtttgggtaatagagcgagattgttttaaaaaaaaaaaatgaataaataaaaataaagggataaaagggtataataaaagcgatatatgtggttttatatgtatttttataaataatagttaatttattgttgtttaggaattattgtaaatttttgtaggaaaatattattattggttttatattaattgttttgaggttataagtttaagaaattttttgatgaagttaatgagtttttggatggttcgtgttcgttttattgtttatttttttgtttttataataggagtgttttttatagtttttagtaaaatgttaattgtaaaagaagaataaaatttattgataattatattgaaatatttaaagagaatggaatataaaagatttagaaattagaaatatttaatttatatttattttacgtatttatgatattgaagatatgtgagagatgtaaaaatgttagatttttttttattattttttttttgattttataaagtttttttaataggattaatttttaaaatgttttttattttaataggtagttttaaagagaggaaatataaatgattaatatataaataatatttaagtttataaaaagtaaagtaaaataatgttatgtttttttttatttattaaattagttaaaattagagtaattattagtgtagatgatattatttttgagaatgtaaaatggtatattttttgtggaatgtagtatggtaatatagattttaataaaggtatattttgatttaataatatttttaggaatttagtgtaagaaaatatgagatgtgtgaaaatttatttaaaaagattttatttttatttaagtatttatttttatatgaaatattggtaaatttaaatatttaaaaaggatatttggaggtgattgattaaatagaatgtagtaaatcgtatatatttttaattgtttggggttcgaattttggttttgttatttgttgggtatatatgtggatatttaatttttttaatagtatgtataatattttaaatttattaaaaattattataaatatatttatataaatatggaagaatatgtaataaaatgatattttttagtagtgatattgtaggtaatgattatttggatttatttatgttgtttgtaattattaaattttttgtaataaattttttaataaaggaaagtaataagttattaataatagaataattaaagttaaaaagaagttgtagaaagagaaattttaaggttttaacgatttaaaatatagatatgtaaatttaaattttatgaatttgttttttagatataaagttatttgttaaaataaaataaatatatatttggttgggcgcggtggtttacgttagtaatttttatattttgggaggttgaggtaggaggattatttgaggttaggagtttaagagggtttagtttttttttaattttttgtttacgattagtttggttaatatggtgaaattttatttttattaaaaatataaaaatttagttaggcgtggtggtgtatgttcgtaattttagttatttgggaggttgagataggggaatagtttgaattcgggacgcggaggttgtagtgaatcgagattaagttattgtattttagtttgggtgatagattgagatatttttttaaaaaaaaaaaaaaaaaaatttatagttaaaaagtaagatatattgaaagtaaaatagtgtattgttgttttttaaagttaattttattttattatattttttttgttttattttttaggtattaaatattggggttaaaagattagaggttattttatttaagtttatttttggaatgaacgtatttagaatatatgatttttatttttttattaaagaattatttaattattttaggtttagttattttaggaataggaatgaatttggagataacgtgggattttagttagtttattttttatatttttttttattgtttttttaaattttttggggttattaataaatcgattaatttaattaaatatttttagaaagtgaagtaggaaatattatgagttatgttattaaggatgaagtgtaagatagtgagaaattagagaaggaaaataatttaattatagttgttttttttttttaattttaaaggtgatttgtttgtagttttgaattcggatatatattagaattaattagggaaatatttattttttaggaaatttaatatatttttagtgttaaaattttggtttgttttaataattttttttttgtagattaataaaggttgaggatataaaatagttaagttgtttttattatattatttttaataaataatgataagtataaggtaggaatagttagaaattaagttttatattggagaggtaaatttaaatgttaataagagttagaaaataaaaattttatttttaaatgatagtttaatttgtaaaaaaatattgtttagattaagaaaatatgttttcgggtaatatttagattgtaagttattttttttagtttttgttttgtatagttattattagagttaagtaataagttttgattaagattgttagattttaaaacgaattttcgaacgttcgtttttgtttatagtaaattggaagaaaaaatgtaataaaatattgtaaaatttgcggaatttttttgaagaaagattttagtggttatttatggaaatatttatagtgtattaggtggaaatgggagtttgatttaaagtgggaaggggggtagttttgggagagaattattttttatagtagtagaagttgaagaaaaagtaatgagattaatgttttttttttttttttttttgaggcggagtttcgtttttgttgtttaggttggagtgtaatggcgagattttcgtttattgttattttcgtttcgcgggtttaagcgatttttttgttttagtttttcgagtagttgggattataggcgcgcgttattatatttatttaatttttatatttttagtagagatggagttttattatgttggttaggttggtttcgaatttttgattttaggtgatttattcgttttagtttattaaagtgttgggattataggagtgagttatcgcgttcggttagagattattgttattttaagatagaacggggaaaacgtttaaggacgaaattagtttttttgaatcgaggatgtttatatgttgttttttttataggtaattttaattttaaatagagtgttttagaatacgtaattttagtaattttttttataaagggaaatatttttaagtaataaagggttgaggatagttgatttaagtaatgaaataatttataaaggttttaaaatgtgttttttaaaaaggtaatatttatgtttttagtttttttttagtagtttttattttgtataagaatttggtttttggtttaaggagtgaatttataattaattgggagggggaaaaaagtaaaagcgagttaagttggaaggtatgaattttaatttaggttttgttaatgattatttttattattataaaatattatttaaataattagtttttgtgttaagtatttggaattatcgagattttttttttttcgttttatttagtttttttttttttttaaagagttcgtagtttggttaatttaaaaaaatatagtataaaaataagtgtggtagttaagtattaggttttatatcgatagatagagatggtattttaatatttaatttaaaggttttaaaaattaaaaagtatatttttttttttttgatgattggttaaaatgtaggtttaggataggcgtttttttaaattttgtttttttattggtcgttatttttattcggatgtaatttgaatttttcgtttttttgttcggaaataaatttagttatttttttttttggtgtcgttagtaggtttttttgttttcggggaaattgtagcggaagacgggggtttcggggtggttgtttttggggagatattcgtaagttttttttttttagtagtaattgaagtaggaagttgtaatatagattgcggttttttcgttattttgtttggagatattcgagagcggaagtagcgattgagcgcgtgtagtgggcgtgttttttttta

SEQ ID NO: 26 - DNA, 29256 bp, Artificial Sequence
  chemically treated genomic DNA (Homo sapiens)
tggagaaaagtacgtttattgtacgcgtttagtcgttattttcgttttcgagtgtttttaagtaagatggcggaggagtcgtagtttgtgttgtagttttttattttaattgttgttggaggggaaggatttacggatgtttttttagaaataattatttcggagttttcgtttttcgttgtagttttttcgggaatagaggaatttgttggcgatattaagaaaaaaagtaattgaatttattttcgggtagagaggcgggaggtttagattgtattcgagtaggggtggcggttagtaaagaagtaaaatttagaggagcgtttgttttagatttgtattttgattagttattagaagaaaagaagtgtattttttgatttttaaggtttttaagttgagtgttaaaatattatttttgtttatcggtgtagggtttgatatttggttgttatatttatttttatattgtatttttttgagttggttagattgcgagttttttgaaggagggagggagttgagtggggcggggggaggggggtttcggtaattttaggtatttaatataggagttaattatttgagtaatgttttatggtggtaggggtggttattggtaaagtttggattagaatttatgttttttaatttaattcgtttttgttttttttttttttttagttggttgtgaatttattttttaaattaaaaattaaatttttatgtagaatgaagattgttaagggaaagttaaaggtatagatgttatttttttaagaaatatattttggaatttttgtgagttattttattgtttgagttagttatttttaattttttattgtttgagaatgtttttttttgtaaaagagattgttaaaattacgtgttttaaagtattttgtttagagttagagttgtttatgggaaaagtagtatataagtattttcgatttagagaggttgatttcgtttttagacgtttttttcgttttgttttaagatgatagtggtttttggtcgggcgcggtggtttatttttgtaattttagtattttggtaggttgaggcgggtggattatttgaggttaagagttcgagattagtttggttaatatggtaagattttatttttattaaaaatataaaagttagatgggtgtggtggcgcgcgtttgtaattttagttattcgggaggttgaggtaggagaatcgtttgaattcgcgaggcggaggtggtagtgggcggaggtttcgttattgtattttagtttggataataagagcgaaatttcgttttaaaaaaaaaaaaaaaaaagatattggttttattgttttttttttaatttttgttattgtggaggataatttttttttaagattgtttttttttttattttaaattagatttttatttttatttgatgtattataagtatttttatggatagttattggaatttttttttaaaagaatttcgtaggttttatagtgttttgttgtatttttttttttaatttattataggtaagagcggacgttcggagattcgttttaaggtttaatagttttagttaaaatttgttatttgattttgatgatagttgtgtaaaataaaagttaaaaaaaatggtttataatttaaatattgttcgagggtatatttttttggtttggatagtatttttttgtaaattgaattgttatttaaggatgagatttttattttttggtttttgttagtatttgagtttgtttttttaatataaaatttagtttttaattatttttattttgtgtttgttattatttgttgaggataatatgatgaaagtagtttaattgttttgtatttttagtttttgttaatttatagaagaaagattgttgaaatagattaaggttttggtattggaggtatgttaggttttttggggagtaagtgtttttttagttgattttaatgtgtattcgggtttagaattataagtaaattatttttaaaattaaaaagagagggtagttataattaaattattttttttttttggttttttattgttttatattttatttttggtagtataatttatgatattttttgttttattttttggaaatgtttaattgaattaatcgatttattgatagttttaggggatttgagggagtagtgaaaggaggtatgaaagataggttaattaaaattttacgttatttttaaatttatttttatttttaagataattggatttaggataattaagtagttttttagtaggaagataaagattatgtgttttagatgcgtttattttaggagtaaatttgaataaaatgatttttgattttttggttttaatatttaatatttaaagaatggagtaagaagggtgtaatagaatagagttaattttagggggtagtaatatattgttttgtttttaatgtgttttgttttttgattgtagatttttttttttttttttttgagaggatgttttagtttgttatttaggttggagtgtagtggtttaatttcggtttattgtaattttcgcgtttcgggtttaagttatttttttgttttagttttttaagtagttgagattacgggtatgtattattacgtttggttaagtttttgtatttttagtagagatggggttttattatgttggttaggttggtcgtgaataagaagttggaaggggattgggtttttttgaatttttgattttaagtgatttttttgttttagttttttaaagtgtggagattattggcgtgagttatcgcgtttagttagatgtatgtttgttttgttttagtaaataattttatgtttgagagatagatttatagggtttgggtttgtatatttgtgttttggatcgttgaaattttaagatttttttttttgtaatttttttttggttttggttgttttattgttaataatttattgtttttttttattaaaaagtttattatagaaaatttggtagttataaatagtataagtaaatttaagtaattattgtttataatgttattattgagaaatattattttgttgtatatttttttatatttatgtgaatgtgtttgtgatggtttttaatgaatttaagatattatatatgttgttggagagattaaatatttatatatatatttagtaagtggtagagttaggattcgaattttaggtagttaaaagtgtatgcggtttattatattttatttaattagttatttttaaatattttttttgggtatttaggtttattagtgttttatataaaaataaatgtttaaatggaggtgaaatttttttaagtgaatttttatatattttatatttttttatattggatttttagaagtattattgaattaaagtatatttttattaggatttgtattattatattgtattttataaagggtatattattttatatttttaaaagtagtattatttatattggtaattattttaattttaattagtttggtgggtgaaaagggatatgatattattttattttgttttttgtgaatttaaatattgtttgtgtattgattatttgtattttttttttttggaattgtttgttaagataaaaggtattttaaaaattagttttgttgggagaattttgtaggattaagaaaaaaatgatggaaaagaatttaatatttttatattttttatatatttttagtattataaatacgtaagatggatgtagattaaatatttttgatttttaagttttttatattttattttttttagatgttttagtgtaattgttagtaaattttattttttttttatagttgatattttgttaaaggttgtgggagatatttttattatgaaaataaagaagtgggtagtagagcgaatacgaattatttaaggatttattgattttattaaaaagttttttaaatttgtggttttagaatagttggtatgaaattaatggtgatgtttttttataaaaatttgtagtagtttttaggtaatagtgaattaattgttgtttatagaaatgtatatggagttatatatgtcgtttttgttatgtttttttatttttttatttttatttatttattttttttttttgagatagtttcgttttgttgtttaggttggagtgtagtgatatattgtaattttttttttttggtttaagcgatttttttgttttagttattttagtagttaggattattataggagtgtattattaagtttggttaatttttgtgtttttagtagagacggggtcgttttagaagtgttagaattatatgagtgtgttattgtgttttgttttattttttgttagtggagtttatgtattttattaaaggattttttggggaattttgaaatgaaatgttttagatttgttttataatgtgaattagtttatgtatttattttttgttttttgtattgttttttttagaaagttatatgaaagtatgtatgaatatttatgtataaaaatttattatagagtattgtaatatttgtatattattatagaagttttggatttttttagtttgttttgatagtagttattttttttttattttttttgaggtaagtaatgtatttttgttatatattgtgaaagaattaggaaatattttatgttaatagtatacgttaagtattttatagtggtagttgtagtaaaggttaattttttaaatgttattgtattttaatttggtatttgattatagaaatttaaatgtttatatgtatttggtatattaagtgttttttatatatatataattatatgtatgagatatttttatttgtaaatagattataattttggatagtattaatttagatagtatgagtggataggtaattgaagaattgttaagtattttttaaataaaattaggaatttttgggggtattgggggaaatatttgtttttgaatataggcgtgtgtatgggtaaaataagtgaattattattaaagtaggatatgttggaatttttttttgttagggaggagtaaaaaattgattttgatttaagagtttggttgtaagtgtttttataaaagtgaagttaaatggaaaagttaggggaatgaggatatatatttgagagaaatgagtagaggttgtatttttgttaaagatgtaatatgaagagttggtaaaataagagtattgagtaatttaatgtattagtttagaaatatatggagatttaagaaaaatgaaatgatattgtgttttgtgttaagagttttgaaattttgtattgtttgtatttatttagtaatttgaaaggatttgattgatattaatatatagtaggttgaattatataaaattgttattatttagttattttattttatgaaaataattttataagggttaaattaaattttttgtagtgaatatgattatttttttttatttaagtaataggaaatataagaattattttgttatttttttagattaaattaaaattgatattttttgaattttatttagtaaaatggatgttaaaggaaaaaaagtaatgttaggaattttgggaagatggtggaattagaaggtatacgtgaatttttttgaaatttttataaaatttagttaattagatagtaaaattaaaaatttttgattagtatttgtaataaaattaggtgataaggtatttttatgagttttaaaatatatgttggtggggataaattattagtaattataggatttgtatggtattagtatttgtgttgaaagaagtagtaagaaatagggttggtatttgacggtattgagaaaagtagaattttaaaaacgttaatagattttgatcgggaagtaaagtgagttaatttaagaatagaagttgattaaggagttttgtttttttttgtagtacgtgatgataatatatttgtattaaggatttgaagggtttaaataattttaaaatggatttaggagggttttgggattttatattgaggagaaattttaggaagtgaaatgaaaattgaaaagggtagggatatgagaaaggaaggaaagagaaagattagattaaaatggtggggaatagagtttggaaagtttaaagtaggtttttatcgttttgaatagtatataaaaaataataaggggagttttgtgaagttagaaaaattattttaatttattttattttaaaagttgaggaaaattaattttatataaaaataataataggaataataaggttaaatttcgtatagtgttataagaaaaacgagatgcggaaaagaatagtatttttagagacgatgaaattaagttagaaatatatatttataagataagtcgaaaattgtaattttgtattttaaaatgagttaaaaataataagatggtataagatatgaaagaaaaacgattagtattagtaaaattaagaaatgaagtttaggaaaagaattagaaataaaagaaaattattttagaaatggagattaaagtaggaggaatataaataacggataatatgttaagaaaaatagaagatgaaaaaaatttaaaaagtgagttaatttttggataagagtttgtgaagaaaattagagtaagggaatagaaaaaatattgtaaaaatgttatttaaggtaagagatttgaaattatatattgaaaaaatatttgaagtatttgagagtattaatttagaataatgaatattaggatgtattttgttaaaattattggatttgaaattatttggaaatgtaggggacgggaaagagggtatgatttagaaagttaggttgtcgttaaattttgatagtaaagatgtttaaggaaaaagtgtgaaataaggtttttatattttgtataattgatttaatcggggtatagattattagtagaaaatgttattttagtgaattatgaggaatttattagatagagagttttataattagaataattagagatattaatttaaagattgttgatttaaaagtagaaagaaaaaaaagttgatttaaaggtaaagtaattaataaaattaattaattttgtttgtttaagtttttgtagtttggaaataatatttttatggaattttatttttataaatttggagtaattatatgtattttaaagtaataaattatacgttatttagcgattttgtagtggaattgatgatgttaatttgttatttatatagagttttatagtatgtaaatagatttatgtttttttgttttttgaattaattgaattgtttttttaaaatttttagttaatatttgttataaaattatattgaatgtttttggttggttttttgttttatcgagtttgttgttttttgtgaatataatattattttattttttgttttttttgtttgtgaagttttgattattgttttttttatttggttaaattttgtttattttttattttttataaagttattattgatttttttgttaggttagagtagtgtatatttttgtacgttatatattttattagatgtattttttttattcgtatttatttatgtgtgtttttgttttttttatagattataagtttattgagggaagagattatattaatttttatagttttatgtataatttttagtatattatagatattgataaattaagttgttattgagagtttttttttttatttataatgtataagagtaaaatttggatttgtttataaattgttaggtattgaatataaattatatttgtattataaaaaatttatattataatgtatattgttttttgttatagttttgaaatttttgtgttagaattttatttagttataattataaattgatattttagtatgaattatttaaagataatttaataataacgtttattgagtatatatattaggtattgaaagttagtgtattattttattttgttttttttaatagatttaagaggtataggttttattattttttatattttataaataaagaggatgagagattatttgtaaagttaggatttaaatttaggtgtgttttagagtttatatatttaattattatattatattggttaagagagatgtaagtaatattgatggtttatggttggtgattaaaatagtatttgttaattaattattttgatatttttttttttaaatattaagtttaatttaggatattttagttttaaatttggatattaaaggaaaattaaatatgttatttgtaaataaagttttgttttttaaaaagaaaattattaaagggtattttaatattgtgattttaagtattagaaatattttagtaaaaatagattaaattgaaatattgagtagtgaattttttaaagagtaaggttataaggttttaattgttatttttttttttgttttatttgtttgtaagtgattttattaaaaaatttaagtatatatgttatatatttatttaaggaaagtgtataaattattttgaatattagatatattgatttttggttgtgtgtttgtgtaattattttaggagaaattttttgtgggtaagtggggatatttttacgataatgtaattttttgaatagttagttttttaaaagttatttgtaaaaaatatttaaaagttttttagttatataaagttaggaattattgttttaggaattggaattgtgttatttttatttttttggaggaaaaatgagattttcgtaatgatttttttaaattgattatttagaaaagttaggagtttagagaagttttttttaattgtgaaaataatataaaatagttagttgattggaatgtagaaaaatgtagattaattaggatattattaaatatttttgtttttttttttttttttgtagtttatttatgtgaattagttttttgttttttttttagattaagaagttggaattttttatgaggtaaaaaaaaaaaaaaaaaaaaaaaaaaaagaaagaaattattgttttttttttttaatcgagtatgtatatttgtataatatgtatattgtgtagtattgttaatttatatttttattttaagagatggtatgttatttttaattttttggggtagaaaagatgatttttttgttttgttatttaatattttgattatagaaagatattaataaattatataatgattgaagaattaaggaataaattatattttaaagttatttttatgatttttataaagtaaggttttttttttatttatatttgattttttttatattgtttttataatttgttatttaaatttgtttataagaaattgagaaaatagtataagaatgattgtttaatattttatagagttattgtaatagttattagagtatatatattagtattattattagaaaatagttaaaattatatatattgtggttggatatgtagagaaaggataagattaaaatatataagtttatttatgtttaagatgtttaaaggatagattttattaaatatttaggattattaatatgtgtttgatagaaataggtattttttgaaagagatagtttgtaatataggtaatttaatatacgtgtgtggatatttatgatatatgtggtatttatttttttagttttatttaagaataataaaagattgagtttgatttattgttttttttttttgtagtgttttggtagtgatggtaaattggttttatattattgtaagttttaggcgtggggatgaattataaagaaaattaatttgttattatatgaaatggatttttacggaagagatagttttgaaaagttttgatgtttgtggtaagagatttaatagatgtgatttatttagtatgtgtttattttatgtttatgtataagaaaatatttatagtatgaatggatttagaaaaatgtgatttgtattaatgtattagttattataaaagatggttatgatagtatatttattgtttttatttgttattattattgttgtagatttgtttttaaggttgaaaaggagattaagattgtataaatatttttattgttagtttttaaaatgattgaaattgtttttatggtaaaagttaatatattaaagggtttttttttttttaatgtttatatttatttttatgtttatttttttagttatattgatttgttggttgaatattttaaatagtttagtagagggtagtttattaggtagaaaaggttaggcgttttggttttatatttttgttggggaataataggggaaatggttgtttttgttaatttttagttaatatttagttaggagagtaagtatataggatagattgaaagattgtaattttatataatatatatggtttaattattttattgggatatagaaaaatataaattttggataaataagttatatatttgtttttagttttaatatttaaggatttttgagttttaattatataattgtggtgttattttgttatttatatggtgttaaaagtatttgatgagtaaatttagtagtatttttttgagtgttttataatgtattttttaatttgaaaataataattgaaaaatagttttattgtatattttatgttatgattaaaagtgttatttttattgatgttattagattgataattttttgaagtgaaatttaatttttttttttttttagtattatgtttataatgttatatttttagaaagtattttagattaggtatggtggtttatatttgtaattttagtattttggaaggttgaggtgtggggattgcgtgaagttataagtttgagattagtttggttagtaaggtaagatttttaattttataaaaaaataaaaattaaaaaaaaattattaggttgtagaggtaagaggattttttgagtttagaagtttaagggtatagtgagtcgtgattgtattattgtatttttgttgagtaatagagtgagattttattttaaaaaagaaaaaaaaaggtattttagtaaatcgaatgtaatgtgaatggaattttaaaataggatttaagatggtatgtagtagaatttaaagtaatattattttaaagttaaatgagtatggaaaaggtttgttttttagttttgtttagtttagtttattgaaggaatatatttaattatatttatatatttaataaataaaaatatgttgaattttcgtattgtttgttattgagggtttagatgatagattttaaaaaatcgaaaatattggttgaaatttgtagtatttatttagttattttttttgatttaaataatttaatagtttattaaatttaaggttagttaaatatgtagttaattttatttgtttttttttttaataattttgaagaatatataggattttgtattttttttttttttttttttttttaaagagatagcgtttcggttttgttgtttaggttggattgtaatggtataattttggtttattgtaatttttatttttcgggtttaagtgatttttttgttttagttttttgagtagttgggattataggtatttgttattatattcgtttaattttttgttatttttagtggagatagggttttattattttggttaggttggttttaaatttttgattgattttaggtgatttattcgttttggttttttaaagtgttgggattataggtgtgagttatcgtgtcgggtttggattttgtatttttttaaattatatttaattattttttgatttttatttaaagaattattttgcgttaaatttgtaatattaaataataattaagtttggattcgataagttattgggtgattagaatttataatataatttatttttaatttaaatttttaagtttgattaaatttgggggaaaaattgaatatttaggtgatattttaaattttttttgtgattaaatagatgttattaatattatgttttattttattgtgtatagatgatttatggtatataaagtatatgtataatattgtaatattgtatttttatttttaaaagtatgttaaagattttataatgaatttattatatttaaggaataaggtaaattaatgtttattcgaaattaaaatgagattggataatttttggaatttgatttttgtaagttttagttttaaagggattttaaatatttattagaacgaagtatagtgtattttttagattatatgatattagttaattaatttagttgtaatataaagtgagaaagttttaggtgttgaaggagtgtgaaaataaaaatttttttttatgtagtttttgttttattttttaaggattataatatgttgagtaaatttttggtattaaggaagttagttataggttacgtaatgaaaattatttagaaaatagtttagtaaatattattatttgaatatagtttaaatcgtatttatataaatattttgtttatattatttaatttaaattggattatttattattttttgaagatgttttgtgttttttgttatttatttttgttcgtgtagtttatttatatttttatttttttaaattttaatttttttttaaggtttgatttagattttaattttttaaaggttatttgaattatttaaggagaagatatttttttttttataaaaatatttagagtaaattattattattaaattatttattgtatattgttttagagttatgtgtttagttattttggtttttatttggtatttatatatatataatatttagtatatttttttatatgtaaataattagtaatgtaatatatcgagtgaatgaaattgtgattagtaaagtatgatagttaaaaataaaggaaattttgtatagtttaagtttttgtatagtagaaggtaatggaaaatatttgtaatatatgatagtgtttttaatgttttaagtatatgaagaatttgttttaattggtaagaaaagattaattgaaaaataggtaaaatatattaaatttcgatttataaaaagatataaatggttaataaaatatgaaatattttgaattttattggttataaaaaatataaataaaaataatgttgattgataataaaaataatgtatattttgttattagtagagttgtggggaaattttgttatattttggtgaatagaatatgagttggtatattatttttagggggttatttggtaatattaaaaattttgaaacgtaagtataaattttagtttgttcgtataatttgttatttatatattgagtgtttattatgttttaaatattggaataatattaataaagtttataagagattaataaagtttttgtttttggagttatttttatgttgatttaagggggtaggatagatttttagatttgaatttaaatttcggaagtttttaaaatagaatttttagaaataatggaaagtaatttgatatttgatattagttattatatttatgttttcgtatttaatattaatgaaagataaaacgtgagtaaaatttttagaggaatttttataaattaatttttatagttttttttgttatagttgatatatatgaatttaggttgattatttttagtgatagataaaaaggatgttttgtttattttgagatggttttatttgttttataattgttttttttataatatggtaaaatttgtttttttgttttttttaagtatttgtttttagtttttttatttatatttataaaatatattttttttttttttttgttttattttttttaagttttgttttaagaatgataaatttatttttatagttgtttagaattttgatttttttttaatttagttttaatttattagttttattatttaaagtaatttatagatttaatgtaattgttattaaaatattagtgatattttttattgatatagagaaaaaaaaatttaaaatttgtatggaattataaaagatttagaatagttaaagttattttgagtaaaaatagtaaagttagaggtattatattattgggttttaaattatgtattataaagttatagtaataaaaatagtatgatagaagtataaaaataagatatagattaagggaatagaatagagaatttagaagtaaatttatgtatttatttatagttaatttttttgataaagatattaagaatatatattggggaaaggataattttttttataataaatggtgtaggtagaattgagtatttaaatgtagaagaatgaaattagattttttttttattatatataaaaattagaatagattaaagatttaaatgtaagatttgaaattatgaagagaaaattggggaaattaaaagtttaagttgggtaaagattttttgtaagattttaaaaatataattaatgtgaaaatgagtaaatgagatgatattaagttaaaaagttgtatagtagaggaaataaagtgaagaaatatgttatagaatgggtaaaaatatttgtaaattatttatttgataaggaattaaaaacgaatatataaagagtttaatagtaaaaaaaaattaaaaataggtaaaagatttgaataggtgttttttagaagatattaaaacgggtaataggtatatgaaaaaatgtttaatattattaattattagggaaatgtaaattaaaattaaatgagttattatattttagtttaaatgatttatttaaaagataggtaataatggatgttggtgaggatgtggagaaagaatatttgtatattgttggtgggagtgtagataattaaagttattaaggagaagagtatgaagtttttttaaaaaatgaagaaaagaattattgtgtaatttagtatttttattgttggttgtaaatttaaaggtaagaagatttgtatatcgagatatttgtattgtagtagtatgtataatagttaagatatataattaatttgagagtttatgtatggattaatggataaagaaagtgtatatgatgttattttgagttttaaaaaagaatgaaattttgttatttgtaatatggaattggaggatattgtgatgttaagtgaaagaagttaggtatagaaaaataaatagtatatatttttatatgtgggagtttaaaaaaaaaatgtttttaggattggttggtaagatggttaaataggaatagttttagtttgtagttttaagtgagatgaatgtagaagtgggtaatttttgtatttttaattgaggtattttgtttattttattgggattgggtaggtagtgggtaaggttaaagagggtgagtagaagtagagtggggtgtcgttttatgtaggaagtggaaggagtaggggagtttattttttttagttaaaggaggttgtgagggattgtgttatttggtttagatattatattttttttttggttttagaaatttatagattaagagatttttttatgtgtttatatttttagggttttgggttttaaaaataaaattgggtagttgtttaggtagatatcgagttagttgtaggagttttttttatatatcgatagtcgaattgattagtggaagaaaggatattagagattgaagattaatttattgaaatgaggcgtgaaggaaagattgagaaaaaagattgaaacggaatgaataaagtttttaagaaatatgggattatgtggaaagattaaatttacgattgattggggtttttgaaagtgatggggagaatgtaattaagttggaaaatattttttaggatattatcgaggagaatttttttaacgtagtaagataggttaatatttaaatttaggaagtatagagattattataaagatattttttgagaagagtaattttaagatatataattgttatagtttttaaagttgaaatgaaagaaaaatgttaagggtaatagagagaaaggttaggtaatttataaagggaagttattagattaatagtggatttttgtagaaattttataagttcgaagagagtggaagttaatatttaatattgttaaagaatttttaatttagagttttatatatagttaaattaatttttataagtaaaggataaataaaattttttatagataagtaaatgttgagggatttttgttattattaggtttgttttataagagtttttgaaggaagtataaaatatggaaaggaaaaattagtattagttattgtaaaaatatattaaaatataaagattaatgatattatgaagaaattgtattaattaatgtgtaaaataattagttagtattatgatgataggattaaatttatacgtaataatattaattttaaatgtaaatgggttaaatgttttaattaaaagatatatattggtaaattggataaagagttaagatttattagtgtgttgtatttaggagatttattttttatgtaaagatatatataggtttaaaataatgagatggaggaatatttattaggtaaatggaaaataataataataataaaaaagtagggattgtaattttagtttttgatataatagattttaaattaataaagtttaaaaaagataagggtattatatcgtggtaaagggattaatgtaataagaagagttaattattttaaatatatatgtatttaatatagatgtatttagatttataaaataagtttttagagatatataaagtgatttagatttttatataataataatgggagattttaatatattattgttaatattagattaataagatagaaaattaataaggatatttaggattggaaattaatgtgtaaaaattataagtatttttatatattaataaagataagtagttaaattatgagtgaatttttatttataattgttataaagaaaatatttggttgggtacggtggtttttgtttgtaattttaatattttgggaggtcgaggtgggtagattacgaggttaggagatcgaaattattttggttaatatggtgaaattttatttttattaaaaataaaaaaataaaaaaaattagttgggtgtggtggtgggtatttgtagttttagttattcgggaggttgaggtaggagaatggtgtgaatttaggaggtagagtttgtagtgtgagtttagatcgtattattgtattttagtttgggcgatagagtgagatttcgttttaaaaaaaaaagaaaatatttaggaatatattttataagggatatgaagggtttttaaggttttttgtttaaggagataagagagaatataaataaattgaaaaaaattttatgtttatggataggaagaatttatattatgaaaatggttatattgttttaagtaatttatagatttaatgttatttttattaagtcgttattgattttttttatataattagaaaaaaattattttaaatgttatatggatttaaaaaagagttcgtatagttaagataattttaagtaaaaagaataaagttggaggtattatattatttgatattaaattatattataaaagttatagtatttaaaatagtatggtattagtattaaaatagatatatatattagtgaaatagaatagaggttttagaaataatattatatatttataattatttgatttttaataaatttgataaaaggaagtaatggggaaaggattttttatttaataaatggtaatggtattgggaaaattggttcgttatatttagaaaatagaaattggattttttttttatattttatataaaaattaaggtggattaaagattaaaatgtagaatttaaaattataaaaatttttgaaaaaatttaggtaatattatttaggatataagtatgggtaaagattttatgattaaaatattaaaagtaattgtaataaaatttagaattgataaatgggatttaattaaattaaagagtttttgtttagtaaaagaaattgttattagagtgaataggtagtttatagaatgggagaaaatttttttaatttatttatttgataaaggtttaatatttagaatttataaggaatttaaataaatttataagaaaaattaattttattaaaaagtgggtaaaggatatgaatagatattttttaaaagaagatatgtatgtagttaggaaatatgaaaaagagttgattattattgattaattggagaaatgtaaattaaaattataatgagttagtattttatattagttagaatggtaattattaaaaaaatttggaaataatagatgttggtgaggatgcggagaaataggaatatttttatattgttggtaggagtgtaaattagtttaattattgtggaagatagtgcggtgattttttaaggatttagaattagaaatattatttgatttagtaatttaattattaggtatatatttaaaggattataaattattttgttataaagatatacgtatatttatgtttattgtagtattgtttataatattaaagatttggaattaatttaaatttttattaatgatagattgaataaagaaaatgtggtatatatatattatggaatattatgtagttataaaaaagaataagtttatgttttttgtagggatatggatgaagttggaaattattatttttagtaaattaatattgtaatggaaagttaaatacgttatgtttttatttataagtgggaggtgaataataagaatatatggatatagggaggggaatattatatatcggggtttgtgggtgggttgggggtaaggggagggagagtattaggataaatatttaatgcgtgtggaggttaaaatttagatgatgggttgataggtgtagtaaattattatggtatatgtatatttatttaataaatttgtacgtttagtatttttattatagaatttaaaatgaagttgtttttatggaaatatagtgtagatgatggttattagaggttgggaagggtagtaggaaaaggggaatgataaagggttggttaatgagtaaaaaaaatatatagttagaaggaaaaaaatttagtgttgggtagtataattgggtgattatagttaataatatatattttaaaaaataattagaaaagtggagttggaatgtttataatataaaggatgagaaatgtttgaggtgatggatattttagttatttttatttgattattatatattgtatgtttgtattaaaattttatatgtattttatatatatgtatatttatgtatttataaaaatttaaaagtttgattgatttatttgtaaaatatgtttagagtttagttattttttatttgttattattgtggatagagttattattatagtttttttttatttaaattgtaataattaattcgttggtttttttgtatgtatttttttttcgtttagaatttttagtggttttttatattggtgtaaaagttgaagtttttattttggtttatgtgatatgtggttattatttttttatattttgttatttaaatgttgttatttaaatattaagttttttgtaattttagggttgttgtatttattggtttttttatttggaaatttgttttagataaatgttttgttaatattttttagttttcgtttaaatattattttaaggaaatgtttttttgaattttttttgaaatagtaattcgttattttatttatttaattttttttgttttatttttttttattgtgtattttattaagtatttgtatgtttatttttttatgtatgttgtatataatatttgttggtgtgttttttttattaatttaattttattaaaatgtaagttttttgagggtagtggtttagttttgttagtagtgtttggtatatagtatatgttttttaaaatatgttggatagtttttttttttttatatttattattatgttaatgtttgtttgaaaatgtgatagttattgattgttttggataatttagagtatagtagagttatttttttggatttaggtattttatttatgttaataaagtttataatgttaattttttttaatgattatatttaggttataatatgtaatattgttgggaagaatttagatgttttttgtaaagaatttgaaaaaagttttttttggatttgaaattataattttaggatttttaaagaggaatgaggaattagacgaatgtttttattagttaataattttagtattgaggaattttagttaatatgtttttattaattttatttatgtatgtatttaagaaatatttttatttgtgtttaatttgtataaaatattgtgtgttaggttttgatggtgatataaaaataaaatttaagaggagtttgttttaaaggtttttattgttaaagtgatttacgtaagtaattgtaatatatgttgagaaatggtaagtgttttaaggaagatagtgattgttttattgtttaggaggaggagaaatggtatatttgataggaaagtaaaagttggattttaaaataagattgggatatgttgaaatggttggttaggatttaagtagaaggaaaagtttaagtaaaagaatggatttggtaagtatatttaatttggttgaaagatatatttataaagaaaaataataaaaggcgaaatattaagaaaggtagtttatagttaaaatatgaaaaaaaaattaatgttagtttgataagatttattgtataggaaagttagagttattggaagaatgtgattaggaaataatattattagttttgtgttttaggttaagaaattaagtaattgtgaataaaggatatatatgggagaaagttggaattaaggaatttattttagaggttagtgttataatttagttaaaattaaatagaggtttgaatagtggaatagtaataagaatataaagtagagaaaatgataaggagatataaaatttggtaattggttgaatggggtttggataatgatgtaaggaaggagtaggtagtagtggatgaggtttttgagtttgggtgttttattgtagaaatagaatttttaggagtttggaagagtatttttgaaaggagttttatatatattgtatcggaggtgttaaaaggtgttggagattgtagtttgtatgtaaaattaagggaatgtgggtggtatttatatatagataattaatgaaattttgagtgtgagggaagggaggaagttgagagaagaaataataaaaatgtgttaatattagtatattaagaaagttttttgaggtttttgaaggttaagaggtggagttagatgggtataaagatggtaataatagatattggggataattagagggaggatggaggagaaaaagggttgaaattgttggatattatgtttagtatttaggtgataataatatttgtattagaaattttagtattatataatatatttaggtaatttgtatatgtaatttttgaatttaaaaagttgaaaagagggtaggtatagtagtttatgtttataattttaatattttaggaggttgaggtaggaagattatttaagtttagtagtttaagtttagtttgtgtaatataataagattatatttttataaaaaaataaaaaattagttaagtgtggtggtgtacgtttgtagtttttgttatttagtaggcgtaggtagtaggtttgtttgagtttaggtgttgaaagttgtagtgagttaatggttttattgtattttagttttagtgatatagtaagatttttgtttaaaaaaataaataaaagattagttatagattgggaggaaatatatataaattatatatttgatttgtttttagaatatataataaatttttaaaatttaataataagaatagataattaagtttttaaaaggataaaatatttggatattttattaaaaattatttataaataattaattatataaaaatatgtttaatattattagttattatgagagataggataagttggattttttaggtcgattaagaatttttaagttttagttgggaaaggtgattgtaattatttttaaatacggggtttgtaatttagtttatatttaattaattaggtagtaaagagggtttattaaaatataaattaggttaaagtaggaggtaaagaaatagttaaataatatatcgtttgagagtatgggggagggataatgattcggatataaatttaggtattaaagtagggagtggtaattttttttgcgtgtcgtcgtattgtatgggagttgtgtttttattttattaaatttagtaattgtatatttttttggtttgtgtttgttatggttcgagttgagttttcgttcgttttttattattgttgtttgttattgttatagattcgttatcgatttttatttttttagattcggtagggtgttcgttgttttgttgatttagcgaggtatttattgttattttcgattcggttaaaggtttgttattgtttttgtatggttaagtgttcgggttcgttttatttgagttgaatattagtagttgggttttacggtttttttttgtgatttacggtttttaatagagttataatatttatcgtatggtttaaggttttattttttggaatttatgaggttaagaattttagtttagagaataaaaggtttgttgttattttgggagcggtggttattattttgggagttttaagaataaagatttgtttataagaattagagatatagaaaatgaagaatataatgtaatattagtatatttttatttggttaaaattggtaaaattgataatatttggcgaggatgcggggtaattagaatttatatattattgttgagaatgtgaaatggtatagattttttgtaaattagtatgttaattttttgtaaatttaaatatgtattgattaaatggtttagtaattttatttttaggtatttatttaggtgaaatgaaaatttttatttattcgaaaaaatatttgttgaataaattaatgaatgaataataaacgaatggagttattataatgtaaaatgattagataatatttaaaattgttgaaataaaaaaaaatataagtttatttttggaaaaaggaagtaattattataaggaatagttagaagagttaagagattgattttttaagtataggatagatggttaggaatggttaaaagggtttgttgttttttattgattttttagtattattgattttttttaattacgtgaatatattatttttataaaaatgtaaaaagaaaaagaggagttagagaaagaaaatgaattgttagaaaaatttagaagttttattaattgaaatgtagaaaagataaattgtgtttgtattttatttttgttgtttattttaaatatttatggattagattagttgaaatgaagtaattaagagatttaatagaaaatattgttaagaataaaaaataatttgaggaaattatgaaaagtttataggttattttgttataaaatattttgttaatttattatttcgtagtaatatatattattaaggttggtttttggaatgttttttatttgtagttatttttgaataataggtgatttcgtttttaataatattgttagaatataatgtagcgagttttattagagatgtttaagattatttggtataagtaaattttattgtatatatgtatatatacgagggagggtgattatagtttagaaaaaaataggtttttagaagtttagaattttaataattttaaatttaaattattttttgcgtttatttataatgagaaggaagaaatttatatttgtattttttttattttttatattttttttatttaaattttattgtatttgatttgtgttgtttttaacgtattaggtgttatgtatgacgtagaaacgtgtttttttatatgtatgtattagtaggtttttttaagtatatgtttaaggttgaaagatttaaatataattatagttttttaaattattgcgttagagttcgttttatttttttagaaaaagtttttttttatattattaaatgaaatattaggttatttgtattggatattttttaaaagaaaatatttgattttaaaattaaagagtttttggttttttattattttattaattgttttattagagattcgagttttttttgttaaaatatattttagtacgtattttaaaaaatatgtgtgtgtgtatatttaaatatatatatatataaagttttggatttatttttatttagtttggggtatatcgtggatagttttaatcgataaaataggtattttttggtttaggagtggaatttatttttaattttcgtaggttttttataattttttatttggaagaagtgtttttttttttttttttttttttttttttttatttagcgttagttttcgtagttatttttttcgattttttttgtttacgttttagcgtcgcgaattatagcggcggaggtggagcggggagaggcgttaggtcgggcggttaaaacgcgtcgttaaagtgggggagagattgcgcggagtttacgcgatttttgggacgtcggagataacggggtttttgggaaggcgcggagttcggggaagtcggggatgtgcgcgtgagtcgtgttcgtagggttttttcgttttcgttattttttttgggtggtttttcgtttcgtttttttttcgagggtcgttggtatatttttagtgattttaagcgtttaaaaggggttcgggaggatgaattttatagatttgaatttgatttgtgtgtgtatcgcgtttttagcgatttcggatttattgcgttgttaggggtttgggggtgggttttttgttgtttttgcgacgatatttttacgtttcggtattttaatgttgggtttgtgcgtgtgtgtttgtttagcggtttagcgggttgttaggttttttcgtttttagttttttggttcgtttagtttttttatcgtagtttagtagtgagacgcgcgcgtagttagttttttacgagatggaatagatcgaagtgttgaagttacggattttggttgatttgattcgtattttgtattagttttttgtcggcgatgaggttaatgtagaggaggtgtaggttattatggaagtttacgagagcgattttatcgagtgggtaatgtacgttaagttcgattagtataggtgagcgcgttgtagttttaatgttaggcggcgtttattcgtttcgtttgaggaggaatggacgtgggggacgtagtttaaagtgattggttcgggaagttcgggtcgcgttgcgttcgtcgttcgttttttcgttggttagtcgcggggttggtacgattcgtttggggtttcgcggttatagcgtaggcggaaggtggattttattggttttgttgattttcggtcgggaacggcggataggcgtcgggaagggaggttatcgcgcgtttgcgagattttttgtttttttttttttcgtaaatttttttgtttttaaattattagtttttttgtttttggtttcgggagtaatgtttatatttttaagttatcgttaatttcgggcgcggagatgcggagagatcgtatttaggttcgggtttttttgatattttaaggaatcgtttggtcggattagtagagggtgtttttaggggagtattatattagttatcgggagaagtgtgtgatgttgaagaagataagttattcgcgttagttttttattattgcgttttcggtcgtttgtaatcgggtattttatagtaagtatttttatttatgtaaaatagcgttttgtggtcgttagttgttattacggaatttttgttgtttttttttttaaattaatttaattaattttttcgattgtgggtttatttaaatttattgttaagtttcgtagattaaatattcgatcgtcgttttttttagtttttaaatgatttgatttattttatttttgtttttgacgatttgtaatgtaaattaaagatttttattttttagatgtatttgagtgaggtgttttggtaagttggtttttttgtagtttcggtttggtgattaagtcgaatttttttattaatttttcggggttagaggtaaaatttaattatttcgaagtgtgagaggttttattttttttgagtagttagtgcgttagtttttgtggttttttgggtttagggttaggagaaaggggtaagtgaaagaaaagaataaggaaagaagtaagtttgttttttttgggagtaggtttttttagttattttttaatatgtgggatgtttcgtaaagttttgttggtatgggcggttttaattgtattttaggatttgaaatagaaaaagtgaagattattaaggattttattttttatatataagtgatttgaggaaatttttttggtttttattagtttagtttatggtagagtttttttgtagtcgtgaaagttagtagagagtttagtttttaaatttttttgtatttgttttaggtaattgaagatttgttatgggataggtatttttttagatatttgatatatatgaggaatggtaggtaatgaagaagttgaatgatttgtattaggttttttatcgatagcggttttaggttttcggggttagtattgttgttttagagtttatattttaaattattgttaaattaggataggttgtaatagtttttaatttttaatttttagaataagtgtatttttaaggattttgaattagtttcgattgataaattttaaagtttttgaagtgtaattagttgggttgatcggtttttttatagatatttgaggtatagtttattaatataatggatgtagtttcgagggggtagttgggggaagataggagatgggagagaagttaattttatagtattttttgtattaaataggtgtttagcgttgtgaaggattttgttttttgattttgggagggttagtgtagaagaattaagatagaatatgttttcgtgtgggttaggttgtgaattttttgaaagaagttgtagagaagtaataaagattattttaagatttttggaggaagaattaggatttttttgtaggaatttagtttattgtgaattgaaggttgtgtatatagttttttgttaggttataaaggttataaagtagggaaaattgaggttaaaaagtatttattaagtaattttttttaggattatgtttttcggatatttcggggtggggaggaatgggataggatggaaggggtatgttggataagagttaatcgatgacgaagggaaaaaaaatttttaaaaaatggagtaaagattttttttttttaatatgatagtttaaatgaatgttataattatgaaattttgttaattagatgttgttaatagtatattttggattaatagaaattttgacgttgattttgttttttttatagtcgtggtcgtggtttgtagtttgttgttggtggtggtagtggtggtggttggttgtggtgagtgtgtttgtgtgtatgtgtttgttagttattggttttttttaattgtaagaggtttagagggttttttattttattaatgtagttttttttgttttggtagttagattagtttttacggtatttgtggaagattttttattataagggtttttgaatgtggtttgtgtttaggttttagtaaaattaagaattttagaatagttatttaatgaaattttgttttttaagttttgatttagttataggtagaaaaaagaaaaaaaaaaaaataatagtaatatttttgttttaattagtaatgtattttggaaatattttttttgagaaatttattttattagtttgaggttgttatattgagaaatatgtaatttcggttttttttttgttatttttttcgtgttattaattaaaattgagtagttatttttgtaaatgtagcggtttaaaatgaattgtgaaaaaggattttttatttgtgttggatttttaattagaaaattgtatttaaagttgtttagaggtggaaatgttaatatttgtgaataaatggtatttggtgatatatttattttttttagtgtttgttttagtaacgaatttaaaatttttgaatatattgtttttttttaggtatattcgaaattttgtggattaaggaaatggaaaatttaatttgatgattttttgttggggtgaaggatatggtaggtaaaataattatttatttatagatatttattagagtatgttttttagtatatgaaaaatatagtattaggttagttataggttttataagtagtaataaattttatttttttttttttttttttttttttttgagatagtggtttatttttgttgtttaggttggagtgaaatggtatgattttagtttattgtaatttttgttttttgggtttaagtaatttttttgttttagttttttgagtagttgggattataggtatgtattattatgtttggttaattttgtatttttagtagagatggggttttattatgttggttaggttggtttcgaatttttgattttaggtgatttatttatttcggtattttaaagtgttgggattataggtatgagttattatatttagtttttattttttatttatttgtttataatgttttttaattttaataaaaattattaatggaattagtatagggtatttaggtatatattatatatattaaaattagtttttaaaatgaatagtaaattaaatgaggtaagtaatttttttaagttaattatattttgttttttgtgtagtaaaattttatgtgaaattgtgtttatatttgatatttgtggtgtttgaggtgtgtaaataatcgtgggattaaagattaaaggatggagatttgaagttagaaaagtattgtaaatttagaaaatttttttttattttaagttaattttttagtttttttattgaaaaggtaatttatattgattttttgaaatttagttttttaatttatttttagttttacgt

SEQ ID NO: 27 - DNA, 26339 bp, Artificial Sequence
  chemically treated genomic DNA (Homo sapiens)
tcgaatattgtgttgaataggagtggtgagagagggtatttttgttttgtgttagtttttaaagggaatgtttttagtttttgtttatttagtatgatattggttgtgggtttgttataaatagtttttattattttgagatatgttttattaatatttagtttattgagagtttttagtatgaagggttgttgaattttgtcgaaggttttttttgtatgtattgagataattatgtggtttttgtttttgtttttgtttatgtgatggattatatttattgatttgtgtatgttgaattagttttgtattttagggataaagttaatttgattttgatggattgtttttttttttttttttttaaattttttgtagagacgagagtttattattttgtttaggttagtttggagtttttgagtttaagggaatttttttgttttagttttttagagtgttaggattataggtttgagttattatgtttagtatttttttttttttttttttttttttttttttttttttttttttttttttttttattttttttttttttttattttttttttttttttttttttttttttttttttttttttttttgagatagagttttatttagttatcgaggttggagtgtagtggtgtgattttagtttattgtaatttcggttttttgggtttaaatgatttttttgttttagttttttaagtagttgggattataggtgtatattattatgtttagttaattttttgtattttttagtagagacggggttttattatgttggttaggttggtttcgaatttttgatttcgagtgattcgttcgttttggttttttaaagtgttgggattataggtgtgagttaattacgtttagtttttttttttttttttatttttatgtttattttggatttaaggggtatatgtataggtttgttataagggttgatttcgtgatgttgagatttgggtttttattgattttgttatttagatagtgaatataatatttagtgggaagttttttagtttttgatttgtttttttttttatttttgagtttttagtgtttattttttttatttttatgtttgtacgtatttaagatttagttgttatttataagtgagaatatgtgatatttggtttttagtttttacgttaattcgtttaggataatggtttttatttgtatttacgttgttgtaaagaatgtgattttattttttatggttgtatagtattttatcgtgtatatgtattatattttttttatttaatgtatcgttgatgggtatttagggtgagtttatgtttttgttattgtgaatagtgttgtaatgaatatgagagtgtacgtgttttttgttagaataatttattttttttgggtatatatttagtaatgatattgttgggtcgaatggtggttttatttttaatattatttttttttttattttataattgaggagtttttttgagttttaatgtttatatatttttaagtagaatgttttatttatttatagaatatataatggaaattatttagttattgtttaataggtagtttttgatttaatatgttttgagaataatttttatattattagtatagagattaaagatgtggttttataattttgatttttttttaaaagagtaaattttaaagtttgtgatattgtttgtttaattaaaagggagtaattagtatttatagttttgtaatggagttttttataagggaaattagtgtttaggttgtgaataaagtttattggttagtatgttttcgatgtttttggatgttttttagtatttattataaatattaatagtatttgttttaatatttgttttaaaataggtattatataagattaaaaaatttttatgtttatttatggaggatagtttttgaatattttttaaatgatagagattatgtattttatatgaataggttatagaataaaatattttagtttttattagttattaaatttaggatttttttttttaattatagattgtaagagggtagtaatatgtatattttaaaaaatatatataggtgtatatgtatgtgtgtgagtatatatatatatatatatttaataacgagtgaggtttatgaaattgggttatgggttggtagttataattttatttgtagtatttttttattatataaatgttaaaacgggattatagtgtggaaatagaagagtgtaggatatattagaatttgaaattttttttaaggatatgaggtgtttggtagaattttatttatatgttaggaaattttaatatgagttttttaagaaatggaattgaaaagtttagaggaagaggtgagtttataattattaagtatattgaaataaatgaggtttggaattttgtattaagtttgttaagttttattgtgtttttgttatggggggaatttggattttttttttttttttattttattttttgtttttaatatttttaatatttggagtggtaattattgaaaattggagagggatatagagtgatttagggagggtaaagggaggttttttttttgtttttgttttttgaaagttttaaaatttgaaaattattttggagtttttcgaaaatgtttagatatatttaagaatttttattgagtaatataatgttttaattgaggtatatacgttgttttaggagtttgtgaaattttaaagataaaagtttgattatgtttgttttgattttaatgaattatttatataattttaatatatagtgtttaatacgtatgaaagttgtgtaatattttatattttaataatggagaattattaagtaattttggttattttgatattagtattttttgaaattttttaggttgatgtggtaaaggagaaatagtaattttgagttttgaaaagttaggtcgtattttggttttgaaaaattatttgttgtgaatttgggttagtttttgattttttaaatggtataatagttcgttgttataagaggttatattaggaaaattttttaaggatttaagattttgtttatttattgagtttttttgggtgatttgtttaggaggaagtatttgtttttttttgagttgttttattaaagtatttgagtgagaaggtagaatataatgagaatgattatgttggtaaggaagatatatatatgagatgggttattttttatatttacgttagttaaaatcgttttttacgaataaatttagtatttggtattttattcgacggttttaaaaatagagttttaaatttagaaggtaaggtgttatttttagttttttttttcggaggaaaatagtacgtatcgcgttaggttaaggtttacggggatttgatttagtatttgggtaattggtcgttaatggaattgaagatagttgggtttaataagtgtttaggtgatttaggtaagcgaggaaattagatcgaggtttttttgcgtgggataggttaaattttgattaaattatagttgagtcgggacgtttttttgtttaaagtttaaagttcggacgtggttggtagggcgtatcggcgcgtgtttcgtaggttatttttttgattggaatgacggcggcggttggtttttcggggttgtcggggtttttcggggtacgtcgtcgttaggatttttgtagggcgtagatagtaggttttagcgaggttgcggaaggaaagttttgggtgtcggggttgggtttggcgtcggtttttgggtcgggggggtgggggttgcgtcgagacgtttttaggagaagtttcgtcgtcgtcgttatcgcggtcgttcgaggcgggtgtttttgggatatagttttggtttttggggttgtgcggtttatacgatagcgcggagtatgaggtcgaattttattttttagttttaagtttttttattattagggttgggtggtttcgttaggtagagcgtcggtttttttaagagtaaacgattcggatacgtttgcgaagtttgcgcgaagaaggggaagtttgcggttgttcgcgttttttcgttttttcgcggttgttcggtcgaaattaaatcgaggggtggggtggcgaggatagggtacgtcgtaggtttgtgcgggtcgggttcggatttgcgttgtttcgggatgtaaagtataataagagggtcgggatgggtagcgtaggtttgtgaggtttgcgggtgtttttgttttttagtttttttcgtagtcggtttcgtagtggtttatttcggttgtcgggtgcggattcgggtttcggatcgaaggttgtgtgtttttcgtcgtttattgtggtttcgataggtcggggttattgtggcgattacgagagtagttttggcgttatggaggagttcggggttattttttaatcgtatttggggttgtttttggaggagttacgtagggtgagtttaggcgcgatgagtgttacgtggtttaggggtcgcgggagtcgtcgggggaaggaagtagtagatcggttttggggtttaagtcgtcgtggttagaggtttcgaagttagttttcgtttgttgttcggttttcgttcgtgttcgaggtagtagttaggttcgtagggcgtttgagtggtttttgtgtgatggaggaggatttggggttttgggaaggtgaagaaagtatttgtttagttggattttgtaaagatgtaaatgtttttcgatttttaaaattaattagttttttcgttatgttgtttattttgagtagagatacgtggttttttcgattgtgagaaatttgaggattgtttttttaaattagttatatttattgatgtaatttttcgttgaattttgaaagaatatttgaggttgggcggggagttgaaattttgattttgtattttttttttttttggtaaagaatgaatgtttttttgagatgttttattatgagtgagattgtttttcgtttttgttttgttaatgtatagtttagagatagtaaatttttagtgtttaaattttgttttttattttttaggtttagtttataattaagttgtagagatttttttttttaagtgtttttaggtatttttgttgatatgtgtaggggtatttatgtcgtcgtgtttttaaaaattggattaaatttttaaaaagattatttaattattgaggtagttacgattatgtttttttgttaggtgaattaaaggtagtgttgttatggtgtttatgagtttatagtttgtttaatgtatacgtatatatatgtatttaatatgaaaagagtatttttatggagattttaaatggattaagatttagttttggttattagtattatgttgtttgttaagagagagaagataaaaaaaaaaatagtataaagtagaaattgatgaagtgtttatttaagtatatatatatagtgtagggaattaggagttgtattatttagagtgtaaagtgggtttagggagtgatgggtaatgatgtttgtcggagatgtaagtaggttttaagtgttgtaggtgttggagagtttttgaaggttttttcgtggttagatttgtggtttaaaatttaagttttttttgatagtagtatgtagattagatgttagggaaataaaatttgaaatagggattaagggagaggtgatagtagtaaggataggaaagagggtattgtgtggagaaatagtttttaagagttaaaatatgtttgattttattgattgtatgtgaagggtgagagagaaggaatttagaaggatttttaggtttttggttgtggtaatttatttatggaggtagggtttttagaaagagaagtatatttttttttttttattaaaaataataataattaagatttagtttttataggattgttagtgtatatggagaaatgtagaaatatatggagaaatgtagttagattttgtagttttttttagtttggtgcgttgtatttttatttgtatagtttttttttttttttttttttttttgttaaatgcgagtattttggtttgggggttaggatggtataatattgtttcgttttaaattttttttttatttttaaaaattattttgtattgagatatatttatataatataaaatttatttttttataatgtttattttagtgttttttttgttaaatttattatgttatgtaattgttagtatagttttttaatatttttattattttagaaaataaattttattgattagtagttttaatttttattttttattttttgataattattaatttattttttgtttttatgaatatgtttattttgtatgtgttatgtagttatgttatatgtggttttttgtttggttttttttatttagtatgtttttaaggtttatttatgttgtagtatgtaatagagttttattttttttttttttttttttttttttttgagatagggttttatttttgttatttaggggggagtgtagtggtttgattttagtttattgtagtttagatttttttggtttaggtgatttttttattttagttttttgaataggtgggattatagtatatgttattaggtttggttaatttttttgtattttttgtagagatagggtttttttatgttatttaggttggttttgagtttttaggtttaagtgatttgtttatttaggtttttaaaaatgttgggattataggcgtgagttatttcgtttggttttttatttttttttatggtgaaaaaatatttcgttgtgtgattatattatatttatgttatagttgatggatatatggattattaatattttttggttattatgaataatgttgttttgtgtataagtttttatatatgtttttagtttttttgggtaagtatttgggtggaatcgttgagttatatttattatatgtttaattttttgagaattgttaaattgttttttagaggttatattattttatatttttattagtagtttatgagggttttagttttttgtattttttttaacgtttgtgattttttgtttttttttgtttttaattgttatttttgtgggtgtataggtgagtggtattttattttgttgtggtttttttttttttttttttgagattgagttttgttttgttatttaggttggagtgtagtggtatgatttcggtttattgtagtttttattttttaggtttaagtgatttttttgttttagttttttgtgtagttgggattataggtattaattattatatttggttgatttttgtatttttagtagagataggttttattatgttggttaggatgatttcgattttttgattttgtgatttattcgtttcggttttttaaagtgtagggattataggtgtgagtttttttattcggttttattttgttttttgttgttgttgttgtttgtttgttttgttttttaagagatggggttttgttttgttgtttaggttggagcgtagtggcgtgattatagtttattgttgttttaaatttttggttttaagggatttttttgttttagttttttagagtgttggtgttatagatgtgagttattatattaggttttgtggttgttttgatttgtatttttttagtaattaatgatgttgagtatgtgtttattgtttatattttttttggggaaatgtttattgatttttttttgtttatttaaaaaatgggtggtttttttattgttgagttataagtattttttatatatttagggtgttaaatgtttattagataaatgatttagaaagatttttttttattttgtgtattttttttttatttttttggtgtgttttttgaagcgtaagcgttttaaattttgattaagtttaatttattttttttttttttggttgtttgtgtttttggtattatagttaagaaatcgttgtttaagataaggttataaatatttatagttatgtttttttttaagagttttagtttttacgggaagtttttcgatttattttgagtgattttgtttttatatatgttatgaagaatgggtttagatttattttttggtatgtggatatttattggtttattttagtatgatttgtttgaaagaattgttttttttttattgatttgttttaatattgttgaaaataatttattataaatttaagggtttatttttggattttgatttttattttattggtttgtgtttgtttttatgttattattatattatttttaaaatatttttttatttaatgttttgattattgtttttttgtagtaagatatagtagggaagtatgagttttttagcgttgtttttgtttatttacgttttttttttttattaatattgttttggttatgtggagttttttgtatttttatataaattttaggaatttagttttaggaatttaggatttagtttgtttatttttgtaaaaaaggtagttggaattttaataggggttgtattgagtttgttgattagtttagggagtattgtttttttaataatattaagttttttaagttgggtgtagtggtttatgtttgtaattttagtattttgggagattaaggtgagtagattatttgagtttaggattttaagattagttcgggtaatttggtgaaattgttgtggtttttttgttttttagtttagttaggtttaagtttttgttttataattaagaagaattaggtatgcggattttagagagtgagtggaatagaatttattaagtgaaaggaaagtttttagtaaagagggaatgtagggggtggtttttttattagaaggtaggaaagtttttttgtgtggttgggtttgcggttttttgtggatttagaatggggagtgtatgttgattggtttgtgagtatgtaaaaaaggttaaagtaaagatattatttagaggtgggcgtgataatgtagataattaattaggaggtcgggtgcggtggtttatgtttgtaattttagtattttgggaggttgatgggggtggattacgaggttaggagtttgagattagtttggttaatatggtgaaatttttttttattaaagatataaaaaattagttgagtatggtggtgtgcgtttgtaattttagttatttaggaggttgaggtaggagaatcgtttgaattcgggaggcggaggttgtcgtgagttgagattgcgttattgtattttattttgggtgatagggcgagattttattttaaaaaaaagaaaaagaaaatttattagtaaagggtaggtatatgtaaaataggtgaaagatggggattaattagaggaaagtgggttaaataagaaggtaagtttttaatttggtttaaggatttaatttgtggtttggtttttaggttttaaattgtttttggtttgaagttggggttttattagggattcgtttttatttgtttgggtatttggttgttttttgttatttttaaaattttgtttttaaaagaaatataaaaattagttgggtaaggtggtatgtgtttgtagttttgttgtttgaggttgaggtgggaggattatttgagtttggggagggtaaggttgtagtgagttaagatcgtattattgtattttagtttgggtgatagatttagtttttgttttaaataaagaagttttttagtttatggacgtggattggttttatatttatttaagttttttttcgttgttttttataatattttgtagttttagtgtgtattttttttgttaaatgtatttttaataattttattttttttgatgttattatagatggaaatgttttttttattttatttttaggttgtttattgttgttgtatagaaatttaattgatttttttatgttgattttgtattttgtaattttgttgaatttaatagttttgatagtttttttataggttttttaggattttttttgtgtatagaatagtattatgttatttttaaatagttttttttttttttttttagtttggatgttttttatttattttttttttttaattgttttggttagaatttttattataatgttgaatatatgttgatagagcggatattattgtttttgattttaggagaaaagttttttttttttttttttttttatttttaagtatgatgttaattgtaggttttgtatagatgttttttgttaggttgaggaaatttttttaaatcgtattttgttgagtgtgttttgttttttttgttgtttgtttgggatagggttttattttgttgtttaggttggagtgtagtggtatgattatgatttattgtcgtttcgattttttgggtataggtgatttttttatttcggttttttgagtagttgggattataggtatgtgttattatgtttggttaatttttgttgaatgttttgattatgaaacggtgttagatatagttaaatgttttttttgtgtttattgagatgattatgcgttttttttttttttttatttttttaatatggtttataagattattgtatgttaaattaattttgtatttttgggataaattttatttggttatggtatataattttttttatatgttgttggatttggtttgttaatatttttttgaggatttttgtatttggagttataagatatattggtgtgtgattttttttttttgtgtgatgtatttgtttggtttttagggtaaatattagttttatagaataagttaggaagtattttttttttttttatgtttgggaagagtttgagagtgattggtgttaatgttttattttggagaggtgtatttttatggaattttgtgttatagttaagtatttatagggtttgtatgttgatattttttttgttattagtatatattatgtttgaagttagatgaaaaataattttagtttatttttagtatattttgttaatttgattaattgattttttttaaagttatttgattttgaatttttttagtatttatgttttggaaatggaatagattttaagtgttttgtgattaattattatcgtattttatggagggttatttttggaggggttatttattattttttaaattttagtttattagattatatgtaattttgtattatatttgttgatatttgagaaatttggttgttttttttatgtttttgtgagatagggtgttatgttgtagataaaatttaagggtgaaaaatttttttgagaaagttagaataatttagattagagtaatgaatttgagatgaattttttagaatttagtttttttttttttttttttttttttttttttttttgagatggagttttattttgttatttaggttggagtgtagtggcgtgtttttggtttattgtagttttttttcgggtttaggtaatttttgtattttagttttttaagtagttgggattataggtttacgttattatgtttagttaatttttgtatttttggtagagatggggttttattacgttggttagattggttttaaatttttgattttaagtgatttgtttattttggttttttaaagtgttgggattataggtttgagttatcgtgcgtggttaagatttagattttttgtttttttttagtttgttagatttaattagtttaaggttttattttattttatttttttaaagttttttttttttgtaattttagtattttgggaggttaaggtaggtggattatttgaggttaggagtttgagattagtttggttaatatggtgaaattttgtttttattaaaaatataaaaattagtcgggtatggtggtgggtatttgtaattttagttattcgggaggttgaggtaggagaattgtttgaatttaggagacggaggttgtagtaagtttatacggtgtcgttgtattttagtttcggtaatagagtgagatttcgttttaaaaaaaaaaaaaaattttttttttttttaaattattttttaatttttatgtttttttaattttttgtgtgtgtgtgtgtgtgtgtgtgtgttagagtttagttttgttttgttatttaggtttgagtgtagtggtgcgatttgtagtttttgttttttaggtttaagtgattgttttattttagtttttttagtagttggaattataggtgtttgttattatgtttggttaatttttgtatttttagtagagatagggttttgttacgttggttaggttggttttaaatttttggttttatgtgattcgtttacgttggttttttaaagtgttggtatgagttattgcgttcggttttagtttaatgttttaaattagaatttattatgtttttttagaagagaagagttgataaaatgtgattgaatttaagaaatattattgtattaaaggtaattacgtgtttgatttgagagatgtttttggaattgttttttaaagtagagtgttataggttatattgattatataatttttgagttagtgtgcgttttatgtgttgaatatattagttaaaagtaagatgtttggaaaatgtgtaaattgtgaagaaaatttttttttttggtattgtgtattgaatgtttttttttttttaatagtaaaaataatttttttttattattaattgtttgtaatgatattagatttttgcgaattggtatttagggtaatgtagggagaggtagaagtagagattagggtaaagggatattttttagaagtataattaggtttgtttggtataggttatgaagtatagatagtattttggaaggagtatatatttggattagagttataaaagattttggagaggaaaataattattaaatattgtttttataggtagaaagggtttaaaaggaagatttgttgtagaggttttgggttaaagtttgaaaagaattaaattttattatattttagattgtttttaaaatggtattttttttttttttttttatttttttttttttttttttgattaagtaatattttgggtttggtaataaagagtagaataattttattaggtaaggatgagtaatgagttgatttagagaaaggtgaaatatagaagtaatagtaaaagttttaggttgtgttgtgttgaaggtttgttgtggggagaagtaatgtggaaaggttatggttagaagattagggtttttggaggagataatataaataattatttttttttgagtatttgtttggtatgtttaaatagtattatttttattatatttaagagaagggacgtatagaggtagggtggggagatttaaattttaaatttaaatttttattagtggtgtttaaaatttgtttttattttttgagataggttttattttgttgtttaggttggttttgaattaaattttttatttttaaagttgtaaattgattttttttttttgtagggaaattgtatattggggaattgattatattttatagataaaatttgaattggttgaaattagggtaagagtatttgaattttaggttatttagtttttttttttggtttttttttatttttatttttggaaattttaagttatttttgtagaattttagtttgaagataattgtattttattatattgttgttttttatttggcgatagtgattgaaagttgataaaaaaatgtattttgatattttttgtttggtgttagtttggtagtttattttgtgttgattatataaatttgtatttatgtttgtaattaatatttttattaaaagtatatttttaagaatttatttttttttattttgaaggttgtggtagtattgtttgaaggtatgagattagattttaatttttatggttttttatgggaattggtgatatgtgtagttgttgttggattttttgttgtttttttttttttgtggagaagttttagatcggtaagtaattagtgttatattaagagaatgtttattttgttattgggttgaataaataatatgagaaatatatttgttattttaagtaaataagttagaaattatatagggatttagaggtttttgttttttgttttttgttttttttaaaagagatgagggttaggaatgagagttaggtttagtgttgtggtttttatttttaattttagtattttgggaggttaaggtagaaagattatttgagtttaggggtttgtgattagtttgggtaatacggtgagattttattattataaaaaatataaaaattagttggatatgaggatattcgtttgtggttttggttatttaggaggttgaggtgggaggattgtttgattttgggaagtcgatgttgtagtgagttatggttgtgatattgtattttagtttgggtgatagagagagattttgttttaaaaataaagagatgagggttttgtgttgtttaggttggttttaaatttttgggtttaagtgatttttttgtttcggttttttaaagttttgggattataggtttgagttattatgtttaattggaattttttaatgtaagattttttatatatatatatatgtgtgtatatatatatatatatatatatgtgtgtatatatatatatatatatatatgtgtgtatatatatatatatatatatatatatatatatttatatttaaagagatggggttttattatgttgtttaggttgtagtgtagttgttatttatagatgtaattatagtgcgtttatagtttatagttttaaatttttgggtttaagtaatttttttttagttttttgagtagttgggattatataggtttatgttattttgtttagttttattttttttttaattttgggaaattttatttgagataggattttatttttgttattcgggttggagcgtagtggtatgatttcggtttattgtaatttttgttttttgtgttgaagtaatttttttgttttagttttttgagtagttgggattataggcgtgtattattatgtttggttaatttttgtatttttttgtagagacgggttttattgtgttgtttagaatttttggttttaagtgatttgtttgttttggttttttaaagttttgggattataggtattaattattacgtttggtttaattttgggaaatttttaatgtatttttgggattgttattttttagatgttgttttttttatttttgatttttttattttttaatttttattttttaatttttttatggttttttatattttttgagagttttttaatttgaggaattgaaatttattttttatttatatttattgtagagtattttgttttttaaaggtttttttttttatttttatttatattttgtagatgattgaagtttttattttttttttatttgtttgtgttattttagttttaaggttgatttttttataaatgaattttcgtttgttttattatttgagagagaggttaaggaagaaaaaggtttggtttattgtttttttagttagtttagatttatggttttatggtaatattttttaggttgttttattttggatattggtattaagggatatgataataggggttttttgaaattatttttttagggttaaatttgtttggggagtaatgggttaaatgaaattaaataagtatttttagagtaaagttattttagagtttttaatatgttaatttataatgtgaatttttaatagggagtttttaataagtagtatttaggttgggtatggtggtttatgtttgtaattttagtattttgggggatttaggtaggtggattatttgaggttaggagttttagattagtttggttaatatggtgaaattcggtttttattaaaaatatgaaaattggttaggtatggtggtgggtatttgtaattttagttatttaggaggttgaggtagaggaattgtttgaatttaggaggtggaggttgtagtgagttgagatcgcgttattgtattttagtttgggagatagagtaagattttgttttaaaaaaaaaaaaaaaaaagtatttatttttttattggaaatagaatatttttggtttgtatttatataaaggtaataagaaatttgtatttttaagttggtagtagacgttaaatgaattgatttatttgagagcgtatttgttttaatgtaatttttgttaaaaatttgttttaggttaggagtcggttttatgtgggtaagtttttttttttgttttgatttttattgttgtgttgtaaaaatttataataatttatttatggtaatattgatttgatttttttaggacgagagaaaaagtttgttttaatgttttttggattaattgaagaaaaaagtaaattatttgaaaaatttagttttgtttaaaaagaggtaagatatttttgaaaataatatttatgttagagttagagaattttatattttttattgtaggtatttttgtgtaaatttaagattatgaatgttttgtttgtagagtatgagagttttttttgttttttatatttaatatttaattagttttattaattttaattattgtagtaggtgtataatggtgtttttttgtgttttttttttgagtttttttgattgatgaggtcgagtatataaatatattttttgtatgtgtatatttttggtatttgttcgtgtatttaaatgtttttttttcgtaaagatattagttagattggattagggtttattttaataattttattttattttgattatttttaaaggttttgtttttaaatatagttatattttgaggtattggggttggagttttaatatgtgaatttgtggggatataatttagtttataatagtttttgatttatttgaaattagatttgtgatggtgtagttgagggtgtgtgtgtgtgtgtgtgaagatttatttttttttttgggcgtgtcgagttaatgttatttattggaaggattattttttttttgttgttttgtagtgttatttttttaagttattgaatatatgtgagtttgtttttgttaaattttttattttgttgggttttttgtttgttttttgttaataatatgttttttatagtttgtagttttataataagttttagtatttggtatggttaatttatagtttttggttattgtgaataaagttattgtgaatatttttttataagttttttttttgtgggtatgtatttttatttttttttataagtagtagtggaattggtaagttattagggtattagggtaggtatagtttaattgtgtaagataagaaatcggttgggtacggtggtttatgtttgtaattttagtattttgggaggttgaggcgggtaaattacgaggttaggagatcgagattattttggttaatatggtgaaatttcgtttttattaaaaatataaaaaaattagttaagtgtggtggtgggtatttgtagttttagttattcgggaggttgaggtaggagaatggcgtgaattaggagacggagtttgtagtgagtcgagattgtgttattgtattttagtttgggtaatagagtgagatttttttttaaaataaataaataaataaataaataaaaaaattttattggttgtttttattatttttttttggttttggtttttagtagtgttattatgatttgtttaggtgtggtttttttttatttgtttttattggggtttatgatgtttttagaatttgtggtttaatgttttttattagtttagtttttttttttttttttttttttttgagatagcgttttttttttttttttgtttaggttgtagtatagtggtgtgattttggtttattttaatttttattttttggatttaggtgatttttttattttagttttttgagtagttgggattataggtatgcgttattatgtttagttaattttttaaaattttttgtagagatggggttttgttatgttgtttaggttggtttcgaatttttgggtttaagtaattttttcgttttggttttttaaagtgttaggattatagttgtgagttatcgtgttttattttttattagttttgaaatatttttgattgttatttttttatatattgtttttgtttttttttgttttttttttttgggattataaaaatgggtattttaattttttattatattttatttgttttttacgtttttttttagggtttttatttttttgtttgtttatattttagtttagatataattttttttaatttttatgttgttaatagtttttatttatgtttataattattttttaaattatttattgagattttaattttattttttgttttttttagttttgtagttttattgtggttttttttgtagttttttttttttggtataattttattttttaattttatttatatattatgtttttttatttttgttttgttttgttttggtttttttttttttttggagacggagttttttttgttgtttaggttggagtggagtgtagtagcgcgatttcggtttattgtaatttttgttttttaggtttaagtgatttttttgttttagttttttaagtagttgggattataggtatacgttgttacgtttggttaattttttgtattttagtagggatgggttttattgtgttgtttaggttggttttaaatttttgagtttaggtaatttatttgttttggttttttaaagtgttaggattataggtgtgagttattatgtttggtttatgtttttttattttatttatttatgtgttatttttattttttgatttttagaatatatgttgtcgataaatatgtttttttattttaatgattattgtattatttagtagtttatttttggtgtttatttttttttttgttttttagttaagttttgttcgtttgaatgttaggttattttatatgaagtgttagtgataatataataaaaattgtaaagataattttgaagttgtgggtgttgtcgtttttttttagtgaggatttattgttgttttttataggtagttaggttagggatattggaaattttagataattttatgtatttgatttttttttatgtaaaataagttttattgtgtatatttaaggtatagaaattttagataattttgattttgttttttgtaaaataagttttattgtatatatttaaggtataaatatgatgagatacgtgtatagtaaatggttattatagtgaaataaattaacgtatttttttttttttatagttatttattttttgtttatttttttagggtagttataatgtatttatataataaaaattatgaatgtagtatattattattaattatggattttatgttgtatatgagattttttaatttgtttattttatatattttttttttttttattgagatagggttttattttgttatataggttggggtgtagtggtatgattttggtttattgtagtttttattttttgggtttaagtaatttttttattttagatttttgagtaattgcggttataggtatatgatatatgtttgtttgatttttaaattttttgtagagatggggtttttttatgttgttaaggatggttttaaattttttggtttaggtgattttttcgttttagttttttaaattgttgggattataggtatgagttattatattcggttatattttttgatttatatgtttttttttttttatttaatattgttaattattgttttgttttttatttttatatatttgatttttataaaaatttcgtatataagtgagattatgtaatatttttttttttatatttggtttattttatttagtaaaatgttttttaggttcgtttatgttgtagtaaatggtaggatttttatttttttatggttgagtaatattttattgtaaatatatattatagtttttttattcgtttgtttattgatagatatttaggttgtttttatattggttattgtgaataatgttgtagtgaatatgggtatgtagttgtgtgtagaaggtgttaattttatttttttcggataaatatttggaagaaggtttgttggatatagtagttttattttaaatttttttaggagtttttatattattttttgtagtgattgtatttatttatatttttgttagtagtgtatagtaagtttttaatgtttttgatagatggttgaaaattgattttaagtgaaatagtgtatattgaatttagttttttttttttattaatgttataatgaaataatgttgaagaaaataatgttatttaaaggataaaggatttgttttatgtttttttttttttttgtttagaaaaagggtttttttttttttgtaatttttaagtttaggggtataagtgtatatttgttatataggtaaatttgcgttttgggggtttgttgtagagggtttttttttttttatatttttataaatatttgttattttttttgtttttttgataatagttattttaatagatataaggtagtattttattgtgtttttgatttgtatatttttgatgattggtgatattgaatattattttatatatttgttggttatttttatgttatttttagagaaatatttatttaagttttttgtttgtttttaaattaggttgtatgtttgtttgttgttgagttgtatgaggttttttaaaatattgaatattaattttttatttgatatatttttttttaatttgtaggttgtttttttattgtgtttatttgtgtatatttttattttttttattttgtagttttattttaaaggaatttttattttattgttttttttgttttgtaaaagttttttagtttgatgtagttttgtttatttattttttgtttttgtagtttaagttgttgatgtgatagttaataaattattgttaaggttagtgttagggagttttttttttgtgtttttttttaggagttttgtagttttaggttttatgtttaggttttttatttattttgagttgatttttatgtgttgtataaagttaagagtttagttttatttttttgcgtgtgaaatttagtttttttattattatttattgatgagattattttttttgtattgtatatttttggtgttttattgaaaatttgattatatttatttggatttatttttgggttttttattttgttttattggtttgtgtatttgtttttatattagtattacgttgttttcgtgattatagttttggaatataatttaaaatgagttagtttgatgttgttaattttattttttttagaattgttttgattatttgggattttttgttattttatattaaatttagattaaaaaaatttttgtgaagaatgttattgagattttggttgcgtttttatttttttgtgtgttttttaattttttttattaatgttttatattttttagtgtgtagattttttatttttttggttgaatttgtttttaggtattttattttttttgatgttatgtaaataggattgtttttttttttttttttttttttattttttttttattgattatttttgggtgtttttcgtagagggggatttggtagggttataggataatagtggagggaaggttagtagataaataagtgaataaaggtttttggtttttttaggtagaggattttgcggtttttcgtagtgtttgtgtttttgggtatttgagattagggagtggtgatgatttttaacgagtatgttgtttttaagtatttgtttagtaaagtatattttgtatcgtttttaatttattgttaattttgagtggatatagtatatgttttagagagtatagggttgggggtaaggttatagattaatagtattttaaggtagaagaattttttttagtatagaataaaatgaagttttttatgtttatttttttttatatatatatagtaataatttgatttttttattttttttttattttttttttttttttattttataaaatcgttatcgttattttggttcgtttttaatgagttgttgggtatattttttagacggggtggtggttgggtagaagggttttttattttttagaaggggtagtcgggtagaggcgtttttttatttttcggacggggcggcggtcgggcgggggttgttttttatttttttttcggaaggggcggttggtcgggcgggggttgatttttttatttttttttcggacggggcggttggtcgggcgggggttgattttttatttttttttcggacggggcggttggtcgggcgggggttgattttttatttttttttcggacgggatggttggtcgggcgggggttgatttttcgatttttttttcggacggggcggttggtcgggcgggggttgttttttatttttttttcggatggggtggttggtcgggttggggttgattttttatttttttttcggtcggggtggttgtcgggcggagacgttttttattttttagacggggtagttgtcgggcggaggggttttttattttttagacggggcggttgtcgggcggaggggttttttattttttagatggggcggtcgggtagagacgttttttattttttagacggggtcgcggtcgggtagaggtgttttttatattttagacgatgggcggtcgggtagagatgttttttattttttagacgggatggcggtcgggaagaggcgttttttattttttagattgggtagtcgggtagaggggttttttatattttagacgatgggcggttaggtagagacgttttttattttttagacggggtggcggttgggtagaggttgtaattttagtattttgggaggttaaggtaggtggttgggaggtggaggttgtagttagtcgagattatattattgtattttagtttgggtaacgttgagtattgagtgaacgagattttatttgtaatttcggtatttcgggaggtcgaggttggtagattatttttggttaggagttggagattagttcggttaatatagtgaaatttcgtttttattagaaaaatatgaaaattagttaggtgtggtggcgcgcgtttgtaattgtaggtattcggtaggttgaggtaggagaattaggtagggaggttgtagtgagcggagatggtagtagtatagtttagttttggttcggtattagagggagattgtggagaggggagaggggagagggagagggagattgttttttagatttcgtttttggttaggtcgttatttgtgtatagaaatgatatagttttgttttgatattatattttgtatttttattgaatttagttattatatttgtatttttgatgatattttttgggttttttatatataggattatgttatttgcgaatagataattttatttttttgatttggatattttttttttttttatttttttttttttttttttttattttttttttttttttgagataggtttttattttgttgtttaggttggattgtagtagtgtaattttagtttattgtaatttttgtttttcgggtttaagtgatttttttattttagttttttaaattgttgggattatagatgtgtattattgtgtttggttatttttttgtgtgtgtgtgtgtgtgtgtgtgtgtgtgtgtattttttggtagagatagggttttattatgttggataggttggtttcgaatttttgattttaagtgatttgtttattttggttttttaaagtgttggtattataggcgtgagttattatgttaggttttttattttttttttttgtttaattgttttgatagtatttttagtattattttgtttttgttttttgagataaggttttattttgttgtttaggttggagtgtagtggtatggttatggtttattgtagttttagtttttcgggtttaggtgttttttttattttagttttttaagtagttgggattataggcgtgtattattacgtttagttaattttttgtattttttttgtagagatggtgtttggttaagttgtttaagttggtttcgaatttgggtttaagtgattcgtttattttagttttttaaagtgttgggattataggtgtgagttatcgtatttagtttttttagtattgttttgaatagaagtggtggttgtgggtatttttgttttgtattagattttaatggaaaaggttttagtttttttttattgatgatgatatttgttgtaagttttttataaatggtttttgttatgttgaggaattttttttttatttttttttattattttaaaaattttattatttattatttatttatttttttgagatgaagttttgtttttttattaggttggaatgtagtggcgtgatttcggtttattgtaattttgttttttgggtttaagtaatttttttgcgttagttttttgagtagttgggattatagttatgcgttattatggttggttaattttttgtattttggtagagacggggttttattatgttggttaggatggttttgattttttgattttatgatttgttcgtttcggttttttaaagtgttgggattataggtatgagttattatttagttttttgagataaggtttcgttttgttgtttaggatggagtgtagtggtatgtttatggtttattgtagttttaattttttggggttatgtgatttttttattttagtttttttagagtagttgggattataggtgtgtgttattaagtttggttaatttgtttatttttggtagagatgtggttttgttatgttgtataggttggtttcgaatttttcggattttttaaagtgttgggattataggcgtgagttattatatttggttagaattttatttttatatttaaattgttaagggtttttattaagagatgatgttgggttggacgtgagggtgtgtgtttatagttttatttatttgggagtatgaggtgggaggatggtttgagtttaggaatttaagtttaatttgggtaatataggagaatttattttttaaaagaaaaaaaaaatggatgtttaattttgttgaatgttttttttgtgttaattggtatgattatgtggtttttgttttttagtttgtgaatgtgatgtattatattaattgatttgagcgtgtatatattatatatatatatatatatatatatatatatatatatatatatatatatttttttttttttttttgagacggagtttggcgttgttattcgggttggagtggaatggtgtgattttagtatattgtaattttcgtttttcgggtttaagcgatttttttgttttagttatttgagtatttaggattataggtgtttggttaatttttgtatttttagtagagttagggttttattatgttggttaggatggtttggaatttttgattttgtgatttgttcgtttcggttttttaaagtgttgggattatatgcgtgagttattgtgtcggttaatttgtatatattaaatcggttttgtatgttagggataaatattatttgattttaatgtataatttttttgatgtattgttaattttaatttgttgatattttatttaggatttttgtattagtgtttattagagatattgatttgtaggtttgtttgtttgtttatttatttattttttgtggttttttggtttggtttaggtattaaggtgatgttggatttataaaatgtgttaggaaatatttttttttgttgttttttttggaagagtttaagaagttttggtaataattttattttgaaaatttggtaaaatttagtcgtgaagttatttttttttgggtttttttttgttgggaggttagattattttaataatagattgagatatttggaagttgggttttagtttagaggattagtttgtttttggtttcgattttgttgtaaggtaggtaggttttttttttttttttttgagatagttttgttatgttatttaggttggagtgtatgatttcgatttattgtaattttcgttttatgggtttaagtgatttttgtgttttagtttttcgaatagttgggattacgagtatacgttattacgttcggtt

SEQ ID NO: 28 - DNA, 26339 bp, Artificial Sequence
  chemically treated genomic DNA (Homo sapiens)
agtcgagcgtggtgacgtgtattcgtaattttagttattcgagaggttgaggtataagaattatttgagtttatgaggcggaagttgtagtgagtcgagattatgtattttagtttgagtgatatagtaagattgttttaaaaaaaaaaaaagaaaatttgtttattttataataaagtcgaaattaaaaatagattaattttttgaattgaggtttagtttttaaatattttaatttgttattaaagtaatttgattttttaataaagaaaagtttaggaagagatggttttacggttgaattttattaaatttttaaagtagaattattattaagattttttaaatttttttaagaaaaataataggagggaatattttttaatatattttatgagtttagtattattttgatatttaagttagattaagaaattataaaaaataaataaataaataaataaataaatttataggttaatatttttgatgaatattgatgtaaaaattttaaataaaatattagtaaattgaaattaataatgtattaaaaagattatgtattgggattaagtggtatttatttttggtatgtaaagtcggtttaatatatgtaaattggtcggtatagtggtttacgtatgtaattttagtattttgggaggtcgaggcggatagattatagggttaggagttttagattattttagttaatatggtgaaattttgattttattaaaaatataaaaattagttaggtatttgtagttttagatatttaggtggttgaggtaggagaatcgtttgaattcgggaggcggaggttgtagtgtgttgagattatattattttattttagttcgggtgatagcgttagatttcgttttaaaaaaaaaaaaaaaaatatatatatatatatatatatatatatatatatatatatatatgtataatatatatacgtttaaattaattaatgtgatatattatatttatagattgaaagataaaaattatatgattatattaattgatatagaaaaaatatttaataaagttgaatatttatttttttttttttttgagagataggtttttttatgttgtttaggttggatttgaatttttgggtttaagttatttttttattttatgtttttaagtaggtgggattataggtatatatttttacgtttagtttaatattattttttgataaaaatttttaatagtttaagtatagaagtaaagttttggttaggtgtggtggtttacgtttgtaattttaatattttgggaagttcgaggagttcgagattagtttgtgtaatatggtaaaattatatttttattaaagatagataaattagttaggtttggtggtatatatttgtagttttagttattttagggaggttaaggtgggagaattatatgattttaggaggttgaggttgtagtgagttatgagtatgttattgtattttattttgggtaataaagcgagattttgttttaaaaaattaaatagtggtttatgtttgtaattttagtattttgggaggtcgaggcgggtagattatgaggttaggagattaagattattttggttaatatggtgaaatttcgtttttattaaaatataaaaaattagttagttatggtggcgtatgattgtagttttagttatttaggaggttgacgtaggagaattgtttgaatttaggaggtagagttgtagtgagtcgagattacgttattgtattttagtttagtgaaagagtaagattttattttaaaaaaataaataaataataaataataaaatttttaaaataatgaaaaaaaataaaaagaaagttttttaatataataaaagttatttatgaaaaatttatagtaaatattattattagtggggagaaattgaaattttttttattaagatttggtataaagtaaggatgtttataattattatttttatttaaaatagtattggaagggttgggtgcggtggtttatatttgtaattttagtattttgggaggttgagataagcggattatttgagtttaagttcgagattagtttgggtaatttggttaaatattatttttataaaaaaaatataaaaaattaattgggcgtggtggtgtacgtttgtagttttagttatttgggaggttaaggtgggagaaatatttgaattcgggaggttgaggttgtagtgagttatgattatgttattgtattttagtttgggtaatagagtgagattttgttttaaaaaataaaaataaaatagtattggaagtattattaaagtaattagataagaaaaagaaataaaaggtttggtatggtagtttacgtttgtaatgttagtattttgggaggttaaggtgggtagattatttgaggttagaagttcgagattagtttgtttaatatggtgaaattttgtttttattaaaaaatatatatatatatatatatatatatatatatatagaaaaatagttaggtatagtagtgtatatttgtaattttagtaatttgggaggttgaggtgggagaattatttgaattcgggaggtagaggttgtagtgagttgagattgtattgttgtaatttagtttgggtaatagagtgagagtttgttttaaaaaaaaaaaaaaagtaagaaggaaggaagagaaggataaggaaagaaaagatatttaaattagagaagtaaaattatttgttcgtagatgatatgattttatatgtagaaaatttaaaagatgttattaaaaatatagatataataattgaatttagtaaagatgtaggatataatattaaaataaaattatgttatttttatatataaataacgatttagttaaaaacgaaatttagaaaataatttttttttttttttttttttttttttttttatagtttttttttgatgtcgagttaaagttggattgtattgttgttattttcgtttattgtaatttttttgtttgatttttttgttttagtttgtcgagtgtttgtaattgtaggcgcgcgttattatatttgattggtttttatatttttttggtggagacggggttttattgtgttggtcgggttggtttttagtttttaattaagagtgatttgttagtttcggtttttcgaggtgtcgggattgtagatggagtttcgtttatttagtgtttaacgttgtttaggttggagtgtagtggtgtgatttcggttagttataatttttattttttagttatttgttttggttttttaaagtgttgagattgtagtttttgtttagtcgttatttcgtttgggaagtgaagagcgtttttgtttggtcgtttatcgtttaggatgtgaggagtttttttgttcggttgtttagtttgggaagtgaggagcgttttttttcggtcgttatttcgtttaggaagtgaggagtatttttgttcggtcgtttatcgtttgagatgtggggagtatttttgttcggtcgcgatttcgtttgggaggtgaggagcgtttttgttcggtcgttttatttgagaagtgaggagttttttcgttcggtagtcgtttcgtttgagaagtgaggagttttttcgttcggtagttgtttcgtttgggaagtgaggagcgttttcgttcggtagttatttcgatcgggagggaggtggggggttagttttagttcggttagttattttattcgggagggaggtggggggtagttttcgttcggttagtcgtttcgttcgggagggaggtcggggggttagttttcgttcggttagttatttcgttcgggagggaggtggggggttagttttcgttcggttagtcgtttcgttcgggagggaggtggggggttagttttcgttcggttagtcgtttcgttcgggaggaaggtgggggggttagttttcgttcggttagtcgtttttttcgggagggaggtggggggtagttttcgttcggtcgtcgtttcgttcgggaggtgggggggcgtttttgttcggttgttttttttgggaagtgaggagtttttttgtttagttattatttcgtttgggaggtgtatttaatagtttattgagaacgggttaggatgacgatggcggttttgtggaatagaaaagggggaaaggtggggaaaagatagagaaattagattgttgttgtgtatgtgtagaaagaagtagatatgggagattttattttgttttgtattaagaaaaatttttttgttttgggatgttgttgatttatgattttatttttaattttgtgttttttgaaatatgtgttgtgtttatttagggttaataatggattaagggcggtgtaagatgtgttttgttaaatagatgtttgaaggtagtatgttcgttaagagttattattattttttaattttaagtatttagggatataaatattgcggaagatcgtagggttttttgtttaggaaaattagagatttttgtttatttgtttatttgttgattttttttttattattgttttatgattttgttaaatttttttttgcgagaaatatttaagaatgattaataaaaaaaaaataaaaaaaagaaaaaaaaagaaaataattttatttatatagtattaaaaaaaataaaatatttaggaataaatttaattaaggaggtgaaagatttgtatattgaaaagtataaaatattgatgaaagaaattgaggagtatataaagaaatggaaacgtagttaaaattttaatggtattttttatagaaatttttttaatttaaatttaatatggaatagtaaaagattttaaatagttaaagtaattttgagaaaaatagagttggtagtattagattaatttattttaaattatattttaaagttgtagttacgaaaataacgtggtattagtataaaaataaatatatagattagtggaatagaatagagagtttagaaataaatttaaataaatatggttaaatttttaatagggtattaagaatatataatgtagaaagaatagttttattaataaatggtagtgagaaaattggattttatacgtaaaagaatgaaattgaatttttaattttatataatatatagaaattaatttaaagtggataaaagatttaaatataaaatttgaaattataaaatttttagaagaaaatatagggaaaaagttttttgatattggttttggtaataatttattgattattatattaataatttaggttataaaagtaaaaagtaagtgaataggattatattaaattaaaaagtttttgtaaagtaaaagaaataataaaatgaaagtttttttgaggtgaagttgtaaggtaaaaaaaataaaaatatatataagtaaatataataaaaaggtaatttatagattgagaaaaaatatattagataaggggttaatatttaatattttaaaagattttatataatttaatagtaagtaaatatataatttgatttaaaaataggtaaaggatttaaatagatatttttttgaagatgatataaaaatggttaataggtatatgaaatggtgtttaatattattaattattaaggatatgtaaattaaaaatataatgagatattattttgtatttgttagaatagttattattaaaaagataagagagatgataagtatttgtgaaggtgtggagaaaagggaattttttataataaatttttaggacgtaagtttatttatgtaataaatgtgtatttgtatttttgaatttaaaagttataaaaaaaagggaattttttttttagataagaaaagagaaaggtatagagtaggttttttgttttttgaataatattgttttttttaatattgttttattataatattgatgagaaaaaaaaattgaatttagtatatattgttttatttaaagttaatttttaattatttattaaggatattgagggtttattgtatattattggtagggatgtagatgggtatagttattatagaaagtagtatggagatttttaaagaaatttaaaatagagttattatatttagtaaatttttttttagatatttattcgaaaaaaatgaaattggtattttttatatatagttgtatgtttatgtttattgtagtattatttatagtagttagtatggagataatttaggtatttattaatgaataaacgaataaagaaattgtggtatatatttataatggaatattatttagttataaaaaggtggagattttgttatttgttataatatggacggatttagaagatattttgttaagtaaaataagttagatatagaaagaaaaatattgtatgattttatttatatgcggaatttttgtaaaggttaaatatatagagatagagaataaaatagtggttagtagtgttgggtaggagggaagaaatatgtaggttagaaaatatggtcgggtatggtggtttatgtttgtaattttaataatttgggaggttgaggcgagaggattatttgagttagggagtttgagattatttttggtaatatagggagattttatttttataaaaaatttaaaaattaggtaagtatgtattatgtgtttgtagtcgtagttatttaggagtttgaggtgggaggattatttgagtttaggagatagaggttgtaatgagttaagattatgttattgtattttagtttgtgtgatagaatgagattttgttttaataaaagaaaagaaaatatatgggatgaataagttaaaagattttatgtataatatgagatttatagttaataatagtgtattgtatttatgatttttgttatatgagtatattatagttgttttggaggggtgggtagggaatgggtaattatgagagagaaagaatacgttaatttgttttattatagtaattatttattatatacgtattttattatgtttatattttaaatatatataataaaatttattttataaaaaataaaattaaagttatttgaaatttttatattttaaatatatataataaaatttattttatataaaagaaagttaaatatataaagttatttgaaatttttaatgtttttagtttagttgtttatgaaaagtaatagtaaatttttattgaagagagacgatagtatttatagttttaaaattatttttataatttttattatattattattgatattttatataaaataatttggtatttaagcggataagatttgattgagaaataagagaaaaaatgagtattagaaatagattattggataatgtagtagttattaaaataagaaagtatatttgtcggtagtatatattttgaaaattagaaaataaaaataatatataaataaataaaataagagagtataggttaggtatggtggtttatatttgtaattttagtattttgggaggttaaggtaggtggattgtttgagtttaggagtttgagattagtttgagtaatatagtgaaatttatttttattaaaatataaaaaattagttaggcgtggtagcgtgtgtttgtagttttagttatttgggaggttgaggtaggagaattatttgaatttgggaggtagaggttgtagtgagtcgaggtcgcgttattgtattttattttagtttgggtaataggggaaatttcgtttttaaaaaaaaaaaaaaattaaaataaaataaaataaaaataagagagtataatgtgtaaatggaattaaaaaatagaattgtattagagaaaaagaattataaaaagagttataataaaattgtagaattgaaaaaggtaagagatgaaattaagattttaatggatggtttaaaagatgattataggtataagtgaaaattattggtaatatggaagttaaagaagattatgtttagattgaagtgtgggtaaataaaaagatggaaattttggaaaagaacgtaagagatagatgagatataataaaaagttaaaatatttatttttatagttttagaaagaaagaataaaaaagggtaaaaataatatgtggaaaagtaataattaagagtgttttaaaattaataaaaggtagagtacggtggtttatagttgtaattttagtattttgggaagttaagacgggaggattgtttgaatttaggagttcgagattagtttggataatatggtaaaattttatttttataagaaattttaaaaaattagttggatatggtggcgtatgtttgtaattttagttatttaggaggttgaggtgggaggattatttgagtttaggaagtggagattgaagtgagttaagattatattattgtattgtagtttagataagagagagagagagacgttgttttaaaaaaaaaaaaaaaaaaaaaaaaattaaattaataaaagatattaagttatagattttagaagtattataaattttaataaggataaatagaaaaaaattatatttagataaattatagtaatattgttgagagttaaaattaagaaaaaatgataaaaatagttagtagggtttttttgtttgtttgtttgtttgtttgttttgagaaggagttttattttgttgtttaggttggagtgtagtggtataatttcggtttattgtaagtttcgttttttggtttacgttatttttttgttttagtttttcgagtagttgggattataggtatttattattatatttggttaatttttttgtatttttagtagggacggggttttattatgttagttaggatagtttcgattttttgatttcgtgatttgttcgttttagttttttaaagtgttgggattataagtatgagttatcgtgtttagtcggttttttattttatatagttaaattatatttgttttaatgttttaatgatttattaattttattattatttatgaagagaaatgaaaatatatgtttataaaaaaaaaatttgtagaagaatgtttatagtaattttatttataatagttaagaattgtaaattaattatattagatattaaggtttgttataaaattataggttataaaaagtatgttattggtaaaaaataaataaaaagtttaataaaatagaagatttaatagaaatagatttatatatatttagtgatttaagaagatgatattatagaataatagagaaaagatggtttttttaataaatggtattaattcgatacgtttaggaaaaaaaatgaatttttatatatatatatatatatttttaattgtattattatagatttgattttaaatggattaaagattattatggattgaattgtgtttttataaatttatatgttgaagttttaattttagtattttagaatgtgattgtatttggagataaggtttttggaggtggttaaaataaaataaggttgttagggtgggttttaatttaatttgattggtgtttttacgaaaagagaatatttggatatacgaatagatattagaaatgtgtatatgtagaggatgtgtttgtgtgttcgattttattagttaggaaaatttaaaaggaaagtataaggagatattattgtatatttattataatggttaaaattagtaagattggttaagtgttgaatatgaagagtaaagagaatttttatattttgtaaataaagtatttataattttaaatttatatagaagtatttatagtgagaagtataaagttttttgattttaatatgaatattatttttaaaaatattttatttttttttgaataaggttaaattttttaagtagtttatttttttttttaattagtttagaaagtattagagtaagttttttttttcgttttaaaaaagttaagttaatattattatgagtaaattattataagtttttataatataataatgagagttaaagtagaaaaaagaatttatttatataaagtcgatttttaatttgaaataaatttttaataaaaattatattaaaataaatacgtttttaagtaaattaatttatttaacgtttattgttaatttagaaatataggttttttattgtttttgtataaatataagttaaaagtattttgtttttaatgagaaaataaatgtttttttttttttttttttgagatagagttttgttttgttttttaggttggagtgtaatgacgcgattttagtttattgtaatttttattttttgggtttaagtaatttttttgttttagttttttgagtagttgggattataggtgtttattattatgtttagttaatttttatatttttagtagagatcgggttttattatgttggttaggttggtttggaatttttgattttaggtgatttatttgtttgggttttttaaagtgttgggattataggtatgaattattatgtttagtttaaatattatttattaaagattttttattgaagatttatattgtgaattagtatattaaagattttgaaataattttattttaaagatatttgtttaattttatttaatttattgttttttaaataaatttgattttaaaaaaataattttaagaagtttttattattatattttttgatgttaatatttaaaataaaatagtttgagaaatgttattatagggttatagatttgaattgattaaagaaatagtaaattaaattttttttttttttaattttttttttaaataatgaagtaggcgggaatttatttgtaaaaggattagttttagggttgaggtaatataaataagtagaaaagaaatgaggattttaattatttatagaatatggatagagataaaagggaaaatttttaaaagataagatattttataatgagtgtagatgaagaatagattttagttttttagattaaggaatttttaaaaggtatagaaaattataaagaaattgaaaaatagaagttaagagatagggaagttagaagtaaaaggggtaatatttgaaaaatagtagttttaaaaatgtattaaaaattttttaaaattaggttaggcgtggtgattaatgtttataattttagaattttgggagattaaggtaggtagattatttgaggttaggagttttgagtaatatagtgaaattcgtttttataaaaaaatataaaaattagttaggtatggtagtgtacgtttgtagttttagttatttaggaggttgaggtaggagaattgttttagtataggaagtagagattgtagtgagtcgagattatgttattgcgttttagttcgggtgataggagtgaaattttgttttaaataaaattttttagaattaaaaaaaagatgaagttgggtagagtgatatggatttgtgtagttttaattatttaaaaggttgagaaaggattgtttaagtttaggagtttgaggttgtaggttgtaggcgtattataattgtatttgtgaatagtaattgtattataatttaggtaatatagtgagattttatttttttaaatataaatatatatatatatatatatatatatatatatatatatatatatatatatatatatatatatatatatatatatatatatatatatatatatatatatatatatatataaaagattttatattaaaagattttagttgagtatggtggtttaaatttgtaattttaagattttgggaggtcgaggtaggaggattatttgagtttaggagtttgagattagtttgagtaatataagatttttatttttttatttttgagatagggtttttttttgttatttaggttggagtatagtgttataattatggtttattgtagtatcgattttttaggattaggtaatttttttattttagttttttgagtagttaggattatagacgggtgtttttatgtttagttaatttttgtattttttgtagtgatggggttttatcgtgttgtttaggttggttataaatttttaagtttaagtgatttttttgttttggttttttaaagtgttgggattagaggtgggagttatagtattgggtttgatttttatttttgatttttattttttttaaaaaaaataaaaaataaaaaataaaaatttttgaatttttatgtagtttttaatttgtttatttaaaataataaatatgttttttatattatttgtttagtttagtgataaaatgaatatttttttagtatagtattggttatttatcgatttaaaatttttttataaaaaaaagagaatagtaaaaaatttaataatagttgtatatattattaatttttatggaaaattataaagattagaatttggttttatatttttaggtagtgttgttataatttttaagataaagaaaagtaagtttttaaaaatgtatttttggtaaaaatattgattataaatataggtataagtttatgtggttaatataaaatgggttgttagattaatattaaatagaaagtattagagtatatttttttgttaatttttaattattatcgttaagtaaagaatagtagtatggtgaaatgtaattatttttaaattggagttttatagaggtgatttaaagtttttaaggatgagaataagagaaggttaaagaaagaaattgagtgatttagggtttaggtatttttattttgattttaattagtttaggttttatttgtaaagtataattagttttttaatatataatttttttataggaagaaaaaattaatttgtagttttaaaaataaaaagtttgatttaaagttagtttgggtaataaagtaagatttgttttaaaaaataaaaataagttttgaatattattgatagagatttgggtttggagtttgaatttttttattttatttttgtgcgtttttttttttaagtgtaatgagaataatgttgtttgaatatgttagataggtgtttaaaaaagggtaattatttatattattttttttaaagattttgattttttgattatggtttttttatattatttttttttatagtagatttttagtataatatagtttaaggtttttgttgttgtttttatattttatttttttttgggttagtttattatttatttttatttaatggggttattttgttttttgttattaggtttaagatattatttgattaaaaagaaaaggggaaaggtaaggggaaaaaagaaaaatgttattttaagaataatttgaagtatgatggggtttgattttttttaggttttaatttaaaatttttatagtaaattttttttttaggttttttttgtttataagaatagtgtttaatagttatttttttttttaaaattttttataattttaatttaaatatgtattttttttaaggtattatttatattttataatttgtattaaataaatttgattatatttttaaaaaatatttttttattttgatttttgtttttgtttttttttatattattttaggtattagttcgtagaaatttaatattattataagtaattaatgataaaaaaaaattatttttgttattgggggaaaaaaggtatttaatatataatattaggaagaaaagttttttttatagtttatatattttttaagtattttatttttagttaatgtatttaatatataagacgtatattaatttaaaaattgtgtaattaatatgatttatgatattttattttaaaaggtaattttaaaagtattttttagattaaatacgtaattatttttagtataataatattttttagatttaattatattttattagttttttttttttaaaaggatatggtaaattttagtttaaagtattgagttagggtcgggcgtagtggtttatgttagtattttgggaagttaacgtaggcggattatatgaggttaggagtttgagattagtttggttaacgtggtaaaattttgtttttattaaaaatataaaaattagttaggtatggtggtaggtatttgtagttttagttattagaaaggttgaggtgggataattatttgaatttgggaggtaaaggttgtagatcgtattattatatttaagtttgggtgataaaataaaattggattttgatatatatatatatatatatatatataaaggattaaggaaatatggaaattaaggaataatttaaaaaaaaaaaaaatttttttttttttttgagacggagttttattttgttgtcgaggttggagtatagcggtatcgtgtaggtttattgtaattttcgttttttgggtttaagtaatttttttgttttagtttttcgagtagttgggattataggtgtttattattatgttcggttagtttttatatttttagtagagatagggttttattatgttggttagattggttttaaatttttgattttaggtgatttatttgttttggttttttaaagtgttgggattataaaaaaaaaaaattttaaaaaaataaaataaaataaagttttgagttggttagatttggtagattggagaaaagtaaagaatttgagttttggttacgtacggtggtttaggtttgtaattttagtattttgggaggttaaggtgggtagattatttgaggttaggagtttgagattagtttggttaacgtggtgaaattttatttttattaaaaatataaaaattagttgggtatggtggcgtaagtttgtaattttagttatttgggaggttgagatataagaattgtttgaattcgggaggaggttatagtgagttaagaatacgttattgtattttagtttgggtgatagagtgagattttattttaaaaaaaaaaaaaaagaaaaaaagaaaaaaagaaattgagttttaaaggatttattttaaatttattgttttggtttaaattattttggtttttttaaggagattttttatttttaaattttatttataatataatattttattttataaaaatatagaaagaataattaaattttttaaatattaataaatataatatagaattatatgtaatttgataaattgaaatttaaagggtgatgggtaatttttttaagagtaattttttataaagtacggtagtgattaattatagaatatttaaaatttattttatttttaaaatatgagtattaaaggagtttaagattaagtagttttaaaaaaaattaattaattaggttgataaaatatattaagaataaattaaaattgttttttatttaattttaaatatgatatatattaataataaaaagaatgttaatatgtagattttgtgaatatttgattataatataaagttttatgaaggtatatttttttaagataaaatattaatattaattatttttaaattttttttaaatatagaggaggaagaaatattttttaatttattttatgaggttggtatttattttaaaagttagataaatatattatataagaaaagaaaattatatattaatatattttatgattttagatgtaaaaatttttaaaaaaatattgataaattaaatttagtaatatataaaaaggattatgtattatgattaagtgggatttattttagaaatgtaaggttggtttaatatataataattttatgaattatattaagaaaatgaagagaaaaaaaaaacgtatgattattttaatagatatagaaaaagtatttgattatatttagtatcgttttatagttaaaatatttaataaaaattagttaagtatgatggtatatgtttgtggttttagttatttagaaggtcgaggtgggagaattatttgtgtttaggaagtcgagacggtagtgaattatgattatgttattgtattttagtttgggtaatagagtgaggttttgttttaaataaataataaaaaaaataaaatatatttaataaagtacgatttgagggaatttttttaatttgataagaaatatttatgtaaaatttatagttaatattatatttaaagatgaggaaaaaaaaaaaaaaaaagttttttttttaagattaggaataataatgttcgttttattaatatgtatttaatattgtaatggaggttttagttagagtaattaggaaagaaaaataaataaaaggtatttagattggaaaggaagaagaaaaattgtttgaagatgatataatgttattttatatatagagaaaattttaaagaatttatagaaaaattattagagttattaagtttagtaaagttgtagaatataaaattaatatagaaaaattagttgaatttttatataatagtaatgagtaatttgaaaatgaaataaagaaaatatttttatttataatagtattaaaaagaataagattattaggaatatatttaataaaagaagtgtatattgaaattataaaatattgtggaaagtaacgaaggaagatttaaataaatgtaaagttaatttacgtttatgggttggaagatttttttgtttgaaatagggattgagtttgttatttaggttggagtgtagtggtgcgattttggtttattgtagttttgttttttttaggtttagatgatttttttattttagttttaagtagtaggattataggtatatgttattttgtttaattaatttttgtattttttttaaagataggattttgagagtggtaggaggtagttaaatgtttaggtagataggggcgggtttttagtgaaattttaattttaagttaaagatagtttaaagtttgaaagttaagttataagttaaatttttggattagattgagaatttgtttttttgtttggtttatttttttttgattgatttttattttttatttattttatatatatttattttttattaataagtttttttttttttttttttgggatggagtttcgttttgttatttaggatggagtgtaatggcgtaattttagtttacggtaattttcgtttttcgggtttaagcgatttttttgttttagttttttgagtagttgggattatagacgtatattattatgtttagttaattttttgtatttttagtagagaagggttttattatgttggttaggttggttttaaatttttgatttcgtgatttatttttattagttttttaaagtgttgggattataggtatgagttatcgtattcggttttttaattagttgtttatattgttacgtttatttttaagtggtgtttttgttttaattttttttgtatatttataaattaattagtatgtattttttattttgagtttataaaaggtcgtagatttagttatatagggggatttttttgttttttggtaggggaattattttttgtattttttttttgttgagagttttttttttatttaataaattttattttatttattttttggggttcgtatgtttaattttttttggttgtgagataagaatttggatttagttgagttaaggagtagaaagattataatagttttattaagttgttcgggttggttttgaagttttgggtttaaatgatttgtttattttggttttttaaagtgttgggattataagtatgaattattgtatttagtttggaagatttaatattattaagagagtaatattttttaaattgattaatagatttaatgtaatttttattaaaattttaattgttttttttgtagaaatggataaattgaattttaaatttttaaaattgaatttttaaaatttatatagaaatgtaagggattttatatagttaaaataatattgataaagaaaaagaacgtggataaataaaaataacgttgggggatttatatttttttattgtattttattataaagaaataataattaagatattgggtaaaaaaatgttttaaagataatgtagtaatggtatagggatagatatagattaatgaaatagaaattagagtttagaaataaatttttaaatttatggtaaattatttttaatagtattaagataaattaatgagaaaaaaatagtttttttaaataaattatattagaataagttaataaatatttatatgttaaggaatgaatttagatttattttttataatatatatggaaataaaattatttaaagtggatcgaagaatttttcgtaagagttaaaatttttagaaggaagtataattgtaaatgtttgtaattttgttttaagtaacggttttttagttatgatattaaaagtataagtaattaaaggaagaaaagataaattagatttaattaaaatttagaacgtttacgttttaaaggatatattaagaaggtgaaaagaaaatgtatagaatgagagaaaatttttttaaattatttatttggtaagtatttagtattttaaatgtataaagaatgtttataatttaataataaaaagattatttattttttaaatgagtaaaaggaaattaatagatatttttttaaagaagatataaataataagtatatgtttaatattattagttattaggaaaatataaattaaaataattataaggtttggtgtggtggtttatatttgtaatattagtattttggaaggttgaggtaggaggattttttgaggttaggaatttaaggtagtagtgggttatgattacgttattacgttttagtttgggtaataaagtaagattttattttttaaaaaataaaataaataaataataataataataaaaaatagagtaaagtcgggtggggggatttatatttgtaatttttgtattttgggaggtcgaggcgggtggattataaggttaggagatcgagattattttggttaatatggtgaaatttgtttttattaaaaatataaaaattagttaggtgtggtggttagtgtttatagttttagttatataggaggttgaggtaggagaattatttgaatttgggaggtggaggttgtagtgagtcgagattatgttattgtattttagtttgggtgatagagtaagatttagttttaaaaaaaaaaaaaaaaaaattataatagagtgaaatattatttatttgtatatttataagggtggtaattaaaaataaaagaaaatagaaaattataagcgttggagagaatgtagaaaattgaaatttttataaattgttggtggggatgtaaaatggtgtgatttttggaaaataatttggtagtttttaaaaagttaaatatatggtaaatatgatttagcgattttatttaggtatttatttaggagaattaaaaatatatataaaaatttatatataaagtagtattatttataatagttaaaaagtattaataatttatatgtttattaattatgatataaatgtgatatagttatataacggaatatttttttattataaaaagaaatgaagggttaggcgaagtggtttacgtttgtaattttagtatttttggaggtttaggtgggtagattatttgagtttaggagtttaagattagtttgggtaatatggagaaattttgtttttataaaaaatataaaaaaattagttaggtttggtggtatgtgttgtggttttatttatttaggaggttgaggtgggaggattatttgagttagagaggtttaagttgtagtgagttgagattaagttattgtatttttttttgggtgatagggatgagattttgttttaaaaaaaaaaaaagaaagaaaaaagaaatgaagttttgttatatgttataatatggataagttttgaaaatatgttaagtaaaagaagttagataaaaggttatatatagtatgattatatgatatatgtagaatagatatgtttatagagatagaaaatagattagtggttgttaagggatgaggggtgggaattaagattgttaattagtagagtttattttttggggtaataaaaatgttgaggaattgtgttgatagttgtataatatagtgaatttaataaaaaaagtattgaaatggatattataaaaggatgaattttatgttgtgtgaatatattttaatataaaataatttttaaaaataaaaaaaaaatttaaagcggaataatgttgtgttattttagtttttaggttagggtattcgtatttagtaaaaaaaaaaaaaaaaaaaaaaaaattgtgtaggtgaagatataacgtattagattagagaaaattgtaaaatttggttgtatttttttatgtatttttgtatttttttatgtatattggtagttttataaaaattaaattttgattattattgtttttagtgaagaaagggaaatatgtttttttttttaaaaattttatttttatgaataagttattatagttagaaatttgggagtttttttagatttttttttttttattttttatatgtaattaataaagttaaatatattttagtttttagaggttatttttttatatagtatttttttttttatttttattattgttattttttttttaatttttattttaagttttgtttttttaatatttaatttatatgttattattaagaagagtttaaattttaaattataagtttaattacggaaaagtttttaagagttttttaatatttatagtatttggaatttatttatattttcggtaagtattattgtttattattttttaagtttattttatattttaagtaatatagtttttagttttttgtattgtgtgtgtatgtttaggtaagtattttattagtttttattttgtattatttttttttttgtttttttttttttaatagataatatgatgttagtggttaaaattaagttttagtttatttagaatttttataaaggtgttttttttatattaaatatatatatatgcgtatgtattagataaattatgaatttataaatattatggtaatattatttttaatttatttaataagaaaatataatcgtaattgttttaataattaagtggtttttttaaagatttaatttagtttttaaaaatacggcgatataaatgtttttatatatgttaataaagatatttagaaatatttaaggagaaaaatttttataatttgattataaattagatttgaaaaataaaaaataaaatttgaatattgggagtttattatttttagattgtatattaataagatagaagcgaagaataattttatttatggtagagtattttaaaagggtatttattttttattaaaaaaaaaaaaaatgtagaattaaaattttaatttttcgtttaattttaggtgtttttttaaggtttaacgagaagttatattagtaaatgtaattaatttaaaggaatagtttttaagttttttatagtcgaaggaattacgtgtttttgtttaaaataaataatatagcggaaaggttaattagttttaggaatcgggaaatatttatatttttgtaaagtttagttaagtaagtgttttttttatttttttagagttttaggtttttttttattatataaaaattatttaagcgttttacgagtttaattattgtttcgaatacgggcgggagtcgggtagtagacgaggattggtttcgggatttttgattacggcggtttagattttaaagtcggtttattgtttttttttttcggcggttttcgcgatttttgggttacgtaatatttatcgcgtttgggtttattttgcgtagtttttttaggagtagttttaaatacggttgaggggtaatttcgggtttttttatagcgttaaagttgttttcgtggtcgttatagtaatttcggtttgtcggggttataataaacggcggagaatatatagttttcggttcggaattcgaattcgtattcggtaatcggagtggattattgcggagtcggttgcggggggagttgggggataggggtattcgtaggttttataggtttacgttgtttatttcgatttttttgttatattttatatttcgaggtagcgtaggttcgagttcgattcgtataagtttgcgacgtattttgttttcgttattttatttttcggtttggtttcggtcgggtagtcgcgagaaggcggggaggcgcggatagtcgtaaattttttttttttcgcgtaagtttcgtagacgtgttcgggtcgtttgtttttaaaggggtcggcgttttatttggcgaagttatttagttttggtagtggagaggtttgggattagaggatgagattcggttttatatttcgcgttgtcgtgtgagtcgtataattttaaagattagggttatgttttaagggtattcgtttcgggcggtcgcggtggcggcggcggcgagattttttttagaggcgtttcggcgtaatttttattttttcgatttaggggtcgacgttaggtttagtttcgatatttaaggtttttttttcgtagtttcgttggagtttgttgtttgcgttttgtagaagttttgacggcggcgtatttcgggagatttcggtagtttcgagaagttagtcgtcgtcgttattttagttagaaaaatggtttgcggggtacgcgtcggtgcgttttgttaattacgttcggattttggattttagataggaaggcgtttcggtttagttgtggtttggttagagtttaatttgttttacgtaagagaatttcgatttggttttttcgtttatttgagttatttgggtatttgttaggtttagttgtttttagttttattagcggttagttatttaaatgttaaattaaattttcgtggattttggtttggcgcggtgcgtgttgttttttttcgagaagaggagttaaaagtagtattttgttttttaaatttaggattttatttttaggatcgtcgaataaagtgttaagtgttggatttgttcgtaggagacggttttagttgacgtaggtgtaaaggataatttattttatatatatgttttttttgttagtatgattatttttattatattttgtttttttatttaagtattttggtgaagtaatttaaaaaggagtagatatttttttttaaataaattatttaaaagaatttaatagatgaataaaattttaaatttttaggaaatttttttgatgtaattttttgtagtaacgaattgttatgttatttaaaaaattaaaaattggtttaagtttatagtaagtgattttttaggattaaaatgcggtttagttttttagaatttaagattgttattttttttttgttatattagtttgaggagttttaggaaatgttaatattagagtagttaaaattgtttagtaattttttattgttaaggtataaggtattatataatttttatacgtgttagatattgtgtattaaaattatgtgaatagtttattaaagttaaaataagtataattaaatttttatttttagaattttatagatttttagaataacgtgtatgttttaattagaatattgtattatttaataaaaatttttaaatgtgtttgaatattttcggaagattttagaataatttttaggttttagaatttttaaaaaataaaaataaaaaaaaaatttttttttgttttttttaagttattttatgtttttttttaatttttagtaattattattttaaatattaaaaatattaaggatagaggataaaatgaaaaaaaaagaaaaatttaagttttttttatagtaaaaatatagtaaagtttaataaatttagtgtaaaattttaaattttatttgttttagtatgtttaatagttataaatttatttttttttttggattttttaattttattttttgaaaagtttatgttaaaattttttaatatgtaaataaagttttattaggtattttatatttttgagaaagattttagattttaatatattttgtatttttttgtttttatattgtgatttcgttttgatatttgtgtggtaaaggggtgttataggtggagttgtgattattaatttataatttaattttatggattttattcgttgttaagtatatatatatatatatatttatatatatatatatgtatttatatatgttttttaaaatgtatatattattatttttttataatttataattgaaaagaaaaattttgaatttgataattgataaaaattaaaatgttttattttatagtttatttatatagagtatatgatttttattatttaaaagatatttaaagattgttttttataagtagatatgggaattttttggttttatatagtatttgttttaaagtagatgttagaataaatgttgttagtgtttgtgatagatattagaaaatatttaagaatatcggaaatatgttaattagtaaattttgtttataatttagatattgattttttttatgaagggttttattgtaaagttgtaagtattagttatttttttttaattaaataggtagtgttatagattttaagatttatttttttggaagaaaattaaaattgtggagttatatttttaatttttgtattagtgatgtaagagttgtttttagaatatattgaattaggaattatttgttgaataatagttggataatttttattgtatattttgtgaataaatgaagtattttatttaagaatatataaatattagaatttaaagaggttttttaattgtaaaatagaaaaaaaagtagtgttaaaaatagaattattattcgatttagtaatgttattattgggtatatatttaaagaaagtaaattgttttaataaaagatacgtgtatttttatgtttattgtagtattatttataatagtaaagatatggatttattttaggtgtttattaacggtgtattggataaagaaaatgtggtatatatatacgatggaatattatgtagttataaaaaatgaagttatattttttgtagtaacgtggatgtagatggaggttattattttaagcgaattaacgtagaaattgaaaattaaatattatatgtttttatttataagtggtagttaaattttgggtacgtatagatataaagatgagaaaaataaatattagggatttaaaaatgaggaagggagtaggttaaggattgaaaaattttttattgaatattatgtttattatttggatgatagaattaatagaagtttaaattttagtattacgaaattaatttttgtaataaatttgtatatgtattttttgaatttaaaataaatatggaaataagaaagaaaggaagggttgggcgtggttggtttatatttataattttagtattttgggaggttaaggcgggcgaattattcgaggttaggagttcgagattagtttggttaatatggtgaaatttcgtttttattaaaaaatataaaaaattagttgggtatggtagtgtgtatttgtaattttagttatttgggaagttaaggtaggaaaattatttgaatttaggaggtcgagattgtagtgagttgagattatattattgtattttagtttcggtgattgagtgaaattttgttttagaaaaaaaaaaaaaagagagagagagagaggaaggaaggaaaataaaggaaaagagaaaataagaggaaaggaaaggaaaggaaaggaaaagaagaaagaaaagaaaagaaagatgttgggtatgatggtttaagtttgtaattttagtattttgggagattaaggtagaaggatttttttgagtttaggagttttagattggtttgggtaagatagtgagttttcgtttttataaaaaatttagaaaaaaaaaaaaaagaataatttattaagattaagttggttttatttttgggatgtaaggttggtttaatatatataaattaataaatgtaatttattatataaatagaaataaagataaaaattatatgattattttaatatatgtagaaaaggttttcgataaaatttaatagttttttatgttaaaaatttttaataaattaggtattgatggaatatattttaaaataataagagttatttatgataaatttatagttaatattatattgaatgggtaaaaattggaagtattttttttgaaaattggtataagatagggatgtttttttttattatttttatttaatatagtgttcga

SEQ ID NO: 29 - DNA, 20506 bp, Artificial Sequence
  chemically treated genomic DNA (Homo sapiens)
gtttttttagagaaatgttttgtgggaagggttcgaagtataggtgatacgtagagtagagagggtttaggaggaaggtaggagatgatggtattgttaaatggtgaagaagatgaggttagatgtgaattgggaaagaatttttatgtttaggattggttattttgtggattgggttttaaaaattaaaaataagttgtgaatgtttgttttttttaagtagtgttgggtttggttttagtttgaaggtattgatatgtgagggagtattgatggggtagtaattttttggggttaattttggtgtatatcgaatttttttgggttttgtttatggatttattatgtttttgtgattagtgggggaattaaggtagtttattttaaaggattacggttttgattaggattgtatttaaagggtttaaggagtattttttcgtttagcggttgtatagggggaatagtgtatgtattaagatattggttatagaggaggacgttggttttgaataaaaatataggattggataatggataatattttaaataagatatagatgtgtatagtgtttttaggtaatataagatatttttattttttgtttggtgtatagtttatatgaaagttttggttttgagagtttttttgtagggttatggagatagtcgtggatatatatgatgatggatgagatagagaatgatgagtagaacgtggaggatgtggaggtgttcgggatgagggttgggttttattttgttttggttttatattgttgttttagtttagggtagttttgttgtttttttagaagaggtagattcggtttttatgtggatggagaagggggtgagttttttatgtggttttttattattttattttatagagagaagtttttattaggttttgtttaggttgattggttttggtatttttaggcgttttttttggtggttttttattttagggttgattatggggttaggtttttttagtttagtttttttatttgtatagtttagagaatataaaatttaggagttttgagttagaggagtggtttcgtggaaagatattttaataaggtaagtataataatggttttagtttaagttgttacgtgtcgttagtgatattgaataattaaattaaatgaaaaataaatgttatgtattttgttatataattaaatggtgaaaatatggtaaagtgtgtaaaataaagtttttggtaatgtttggggttttgttttggtaggggaggttgtggtaggtttttttttaatattggttttagagttgggtttttattgtaagggttttttaggcgtttgatttttttatattttgaattttttgttgataagaatagagggaaatattattaaggtaggttttttttatatttagttagttttagaaggatagcggtttgcgcggaggttttggggttaatttttatttttaagttgttattttggttatgtatttttttttagaggttttgcgataatagacgggaggggagtgcgagacgtagttaggttgaagcggagggatttatggatggtagaaagtagaggatagatacgtggtaagtattgggcgtggtagacgtacgaaggtatagagaggtttattagagtggttatacgacggggatagggtatattgtttattcggtatcggcgtggggttgaggtttaggatgttgttgttttgtattttggtttcggttgttttaagaggtattttcgtggtttttagtaatttttcgttttcggggttttttagttaggggttatgttatcgtaggtggttttaggtgggattgttggaggtggtataggggtgggtgtataggtggttaggattttttaggaggaacgtatgttggatagagtagtgattatagcgtattttttatttggttttgattggtgtgagtattttttagttttaatttattaggaatttcggttaggttttttatttttttacggcgattttgtttttagtattgggtgtattatttgtttttaggagttttataagttatttgtaaattatagtgagtttttagggtatatatagttatattaagatattaagataggacggattttgtatgcgtttttaaggtgggatttatttttagtttttgtagattttgttttttaggagtgggatagtaagtagtttgtatttttaggtagttttagttgggttttttgtttttagggggttaatagttttttatattgattaggatagattggttatttttttttaggtataaagttttgttgtatgtggagttcgaagaatgtaggcgagtatgggggtataggtttgttttttcggggcgtttttgttaagagttttatggattagagtggttattggtttttacgggaaggatggtagttttaggtagtttatttaatagttttgtgttttaagaggtggggagggtagaagattagggtatttttgtatttagggtttaggtttgtgatttttagtgttggtaagaggaacgtgggttaggagagttgtttaggtaaaagagatagtagcgggaaataaaggtttttggttgaagtattttaggatatttttttaacgaggagaaggtatggttgtgattatagggagtttattaaagtttaaggggatattacgtttcgggatagggtgtgtttgatatgtaggggtttttgtgggtttttttttgaattttatgtgttttattttttaattattttttttttttgtatttattaaaattatgatttaggattcgggtgtagggtgggcgggtgtttatgtgaggtggagaagggttgagaaatttaacgtatttttttttcgagtattattgaaatggggtttttgtttttttattttttcggtttagattagagaaatttgttaaaaaattttatatatatatttatatgggtagggaaggagggtgtaggaaagtttttagagtttaagtggtatttgttttaggtagataaggtattttttatgaatgaggatagaggtagttgtgttttgtagttggagtatacgttattacgtaggaggcgggaggggataggttgggatttttagggatttaggatttttgtaaagttttatagtatatttgttttttacgtgggggattcgtttaaagattttaaagagaattgtttaaagaggagttttttgagaagtgtttttatatttgttttttgagaatgtagtattttttcgggtttattttatatagtttgtagaaatttattcgggtttggggataaagttatttttataatttaggaaggaggggttgaagaagtttttttttaggtggtagagtgttggagggaaaggtaatgggtatttggaaaaagttagggtttatttttaagggttagttagtttttattttttttgagggttatagaggggtggtatattttttttttggcgaggttatttttgttagtaggttgttttgtatattggttaggtggttatagtttggtttttataggaatgtagattgtaagtgtgtggagttggtgagttttttagtgagcgtaggttttttaagagaggaagtggagggcgggttggggggtttagtaatttgggtatttttggagtttttaggttattttggatagagttttgagtatataggtttcgcgttatagattttcgttttagtttttgtataattattttttttataatttagtagattaataagggttttaaaaagtatataaatatagaagtcggtgtggttggtagggtagtaaagtattgtttttttacggaagtttgagtttttgtttagtttgtatgggggtttgttttggaggaggatcgagtaaatttataaagcgtcgagagtaagtgaattgtggtttatttcgaggtggtagataattagtttttttttttttgggtagtttttttttttttttgtcgtttttttttttttatttttttttttttttttatttttttttttttgcgtttttttagataaaattagtagaattattaataatgtggaaataaataaaagttcgttttagtttgtataagatttaatattggttcgtgtattggttaaattgtgtttttagttttaggtttggaggtttttggttaaagtattgtttattagtaatttattaaaataaattggatatttttttttatttaaataaatgtttaatgggtttttagaatatttttgtgaatgggttatagcgattgttaatttgttaatttgaatttgatttttattggggataaggaatttatattttagggtatatttagggttaggttggttatcgtggtttttgttattttattttgttttgtttttatgggatttttttttttttttaatgtagggttgaatttttagttttttttaagaaatgtttgtattttaaattgaataacgttttggaggttgtaggttttaggtttagattgttatttagaagaggagaaaaaaggtagtggttttatttttttttttttagacgtttgtgaatatttttgggaatgaatgcgattgttttggagagtaagggagagagttggttagtagaattttattagagtaattggttcgtgattgttatattaaaatgatttaagttgaatggtatttaatgatttatggggtgaggttatttgtttttgtgaaagttttatattaattatggtttggagttatgggatttttatatgggaaaatgtaaaaggttgatattattagggttgagtttttggggattatatggggaagttaggagaattaaggaggaggagggagggaagacgaattagtgagttaaatattattttttagaaaattagtattgttattttaatcgggttaaaaaaaaaaaaaaaagatttaaaaatttgagttgtagatttaatttgttcgtgagaaaagtttatatattgttatatatgggttgtgagaaggggttttagatatttgattgtaggtaggtttaattatataaattagaaacgtttataagttttattattaataattaatgaattttattttaggtaaataaatttttatatatagtaggacgtttatattatgaaataattagtattttattgttagtgtatataatgttatatttgatataattttagtataagtgaaaaaatatattgtggttaatattgaaaagttgtaattatatttatatattatatatatttttttataaattgttagtagtttgagataatagagaagtataaattattgatatttatatggttttattttaaatatatgaattgttcgattataaatatattttgaaatatatttgttttttaaagaaacgtaaaaaaaaatgtgtataaaaatatatataaaaaaatgttttgtaaaaagttataaatattattaggattttttgtggatcgtatttatgtatggaaatgttattttgttaatagttttgattggaatttgaaattttgttgtggttttaggagggggtagtggtaagatgatggtttatttattgattttttcgtttttgatttcggaaattttagagtttgttagtgtttttatggtatatataggttttagaggtaattataaaatttagttatttaaagcgagtttttagatttaaaattgtatttgattttgtaaagatttgttttttgcgggtaagtagggggattattatatatttttaggagagggttagttttattttggaggaggttaaagacggattttatagagggttcgagttgtggggtaggttttgggaggagagggatgtagggtacgagttttagtaattatttttttttcggttggtgcggcgttgattaggttatagaaatgagaagtagaagtaagattaagtatgttttcggagtcggggagagagtaggaatagttgggagaggggtttttgagtatagttttagtaatagtggtttttatatggagtttatagagttaattattgaggttgaaagaggaggtgaaggtagtggcggcgtttagttttagtcggtatttgagtgttatagaggttttttttttgggaggggcgttgttgcgggagttttagtgtttgaagaaaggatattttttttagttttttgttaagttattatttgattgtgtttagattttttaggggagtagaggagatgttttaaataagttaaatttagattttgaagtattcgttgatttaaaaaatgagaatgagaatgatgatgattgtgatgattatgaaggaattaattgtttgaaaatgttgttgataatataattttttttttagaaaaattttagtaataaaagttttaacgtgtataggtatagggtatggatgaatataagttgtaatattatatcgtatgttataaatgtagggtttaaatgttggtaaattttaggttcgattttagattaatgtgtttattttatatatatatttggtttttatggttaaggtttttttttttacgtttttgtttttttattttttataaggttttagtttttttcgagtgggtttagcggaaagttttttttggttgttgtgtttatttgtttaaagttttttttaggtatttttgaatttattttagtttcgggttaatgtatatttgtttgttgttgttttttagtcgggttttgtgaaaatagaatggtaatagtgtgcggttgtataggaggaaggcgcggttgtaacgtgtgtattcgtttttttaatatttatttagggttttcgttggtatttcgtgttttatttggtacgtttaggttttagaggtgttcgcggtgtgttggggaaagtttagcgttggtagtgtaggaagttttattgtagagatatggaaatgtgaatagaagttttttcggggtagtgtaggggaatttatgtaagggagtatttgagttgtttttgaaggataagtaggagtttggagagtaaataaacgggaagggaaaattaggagtaaatacgttaggggggttattaaagtatatagaggaaattgaggaaggggacgataggatgttttaggtatttggggaggggagaatggagagtaatagagtagaggtttatttggatgggttattttgatagatatagggtcgatttaaggatgggtatgaggaagtttggaggaaggaggtttgttagaagttatcgcggtttgatcgggagggtgattagttagggaggggaggggtagtgtaggtggtttattagaaaatagtttttagaaagattttataagtttattgaatgttttttggttttatttgttttttaaaagtttatatttttaaaagtttttttatatgtaaatttttggggaaggtttgattttatttttttgaattttttgttagaaagttttttggtgttaggtaattttatgtagtttaagtatttaagggttttgaggatagttaagttttagaatagtggtttaggggtatttagggagtttttaagtagtttgtttattaggtgaagaggggtgtagagatgggtgtggttcggagtaatttatattggggtttaaatttggggtttattttttgttaatttagtgtttgtttagatttgagaattgtatttggtatttttaattttaaggtgtatttttaggttagtaaattagtatgattagtgttgtaaagtaggtttaaggtagttaaattgagtatttttaaaatattttttataagagataaagtattatgttgtaggtaaagtatagaaaaaatatttattttttagggttttaaaatatattgtaaataataaatatatttaaggtagtaaagggttaatttaaaattaaaaatagttttttaaaattaaaagtaaaaatatttggtgttgggtggaaaagttttgggaaagttgtagttttggttttaattgttgtttttttattttatttttagtattagaatttttgagtaattaaattttttttaggagattttttgagttttcgttttttcgtgtttagatataggattttttgagtatgagagggtttttaagtatatggtttttttttcgtatttttttcggttttttgtatttagttgagatttttttgttttgtggatgtgtgattttggtttttgttttttaaatgaataaaattaaatgttagtggttgttatttatattaaataatattaaaattttatatgttgtatttgagaaaatataggtaagtgagttgaaaatgttgaagttttatttaatggttaaagaggatttaaattgtatttgggttttgtgagttaatgtagggtattagattttcgaaattggtaggttagttattattgttattagttaagggttggttaatttattaggttttagttaaaattttggtgaagtttatagtttttttagtatttagttgtgttgtgttgaagaatataggtttggaaagaagagagaattattacgagtatagtagggtgtttaggttaagagcggtttttaaaattaatgtttggtggtatattaaaggtttttatgataagaatagttgttattaattatgttaagtttaaggttggatatttggtttgttatttttatatttttaataagattcgggttagatgttattatgttcgttagatgtaattatgttcgttagatgatgtttaattttaagatttatataatttgaagggtatagtttggagtgttgagaattttgagatgtttgacgttggttttggtaatatggttttcgaagaatcggtatgggtatttgtagtttaggttgacgggtttttttagaagaggtaaggataataaggtattttattattttgttagattttggtaatgtgtgtttgggttgtagtagttggtgtagcgattaaggattaagagacggtattattggggtaagttttaggttattggtgtatgttgggaaaggttatttttttaggtaatatagtgagtgttggttgagtttaggtttagtttttatagggtaaggagtttaataggtttggggagagtcggagtttagatgaggcgggagtttaaattagaagttatttgtttagtgttttaagataaaggtagtaattatagtagataacggttttagtttaaggtattgaaatttttagttattttttgtaaaaaaaattttttaagggataattgagaaagatttttttatttagggaaaagaaagggggataagaggttttaggttttttggttttttttttttggtataggtttttagttaggaagtatagtagtatttaggaatgttgtttttttttattttagagatttttttttatatttatttaaagttttggaaggtataaaagaattttggttggttttttatttgtgagttttttgagagtaggttaaggatttattttttgtttagtattttttttaaggtttagagattagtggagttggagttaaatgtggtttttattgtttaggtagggatgttgtagttttaggaattgtattaagatttttgtaaaattattaatttataaaatgttataattgatatttattagtgtaaattagtaaggggtttttgtagaatttattgtttattttttaaatataggattgtaagttttggagggttgggatttgtgtgtgttttttgttttttttttttttttgaagattttatttaagttttatttaatattttaaattatttgaatttgtggatttttttattagagattaaatatatgtttaagaatatttggtttagagatttttttttttttttttttttttttaagtttgtttgtttataaagttttgagagatttttgtggttttgaaattttgtatttttgggaaagaatgttggggaagtaggaggaaattttgagtaaggggtttattttattttattttttttatagattgtaattaattgagggatgatgtggattaggaattgtattgtgtatttagttattaagttgtaggaaaagtggattatttgtttttttatttttttgtttttaggattaaatgtaattttttgaaaattaggaaaaagttaagtattagggtgttggtgatttatggtattggagagatttaaggtagtttttatagttatatttgatttaattttagaaaggtatttttggggttagtttttagtagttgtattgggattttgtaggggaagttagtattgtattgtaattagattatttgggaaagttatttttagggtcggggtttgtagtttgggtaattgaggagttaaacgtttttgagtgttgtgtttttaggtttttttggattttttttgggtttttttaagttgaggtagggggtgggttgggggtggagtaggagaataggaggtcggtagtgaggtataagttttttttcggtaatagtgagtttgaagatatgtagttaagggtaagtgttgtagtcgttttcgttgggatgggtggggttgtgattttttagcgtttagaggagagaagtttttttggttttttaattaagtagtggtgatgaggttagaaattagagtttatttagagtttaatatataggtttttttttttttttttttttattttttgggattatttattttttttaaaagtaatttttgtttttatttttaggatttaaggttcgtttgttaagtagcgaattttaataggtttttttaaagtgatagagtttttaggtgtgtttattaaaagaatatggtttcgtgtgtattttatgtgtttttttttttagttttttgttagtaagattaatttttttaatcgttttggatgtaaattcgtgtatcggtaagagttttgattggttttgatggtatttcggatttgggatcgggtgagtttggttttaggagtttttagaaagttttttagtttaatgtagagataggagtttagttggtttttttaagtaggtttgggaagggggtttattttgagtttaagttcgggaaatttaagggtttagttgtttgacggaagttagttaatgggggaggggtaggatttttggttaagttttttttgtagtgtagtttgaggattaagtgtggggatagggggtatataggtattgtgaggtgaggggaaaataaaataaaataaaatattttggcgatgtgtgtaaggagtagatttgtttggagtttaggtttttgttttggttatttggttgttaatggggtaattttgagggttatgttattttttttaggttaggaggagtttgggatgaattttacgtttttgtgttttttttaggttagttgtatttataatttaaagatcgaggttttttattttaattttttttttagtttttcggggagggggtagtattattttttagagcggcgtattgtgatattttcgcgtttattttattaattagttaataattgtttaaattagagattttataggaatagaagaatatttagtaataaaaattagaaatatgttttatgatttgcgggggggggggggggttagtgtgtagatatagttttagggattttttattaacgacgaatatttttaattgtttttagtttgtgtttttaatatttaggtagttcgttacgattttaggttgtttagtttttttagttcgatttagttgcgttggttttgtttatattagcgtatagtttaagttagttaggacgtcggggttacgtttgtattaatttagttaagggttcgaggcgcgttgggtttgtatagttcgcggttgtaagagtatttagagtgttttttaattttttgtaggaaattttatagttaaggaagtttagcggtttgagttatagggttttgttttgtgtgtttagaggtaatagtttattttggtttgtatcggtgttttgtgatagcgtagcgagtttttttttagcgaaagaaaagaaaaaagtttttttttagtgaaacgggatattacggtttttagtggtttagggttttggagattgaattttgttgtagtttttattttggggtaaagcgtttggttagttggtgataaaagagtttgtttgtaggtgtgtttggggagttggggagggggcgtgtgaggttcggagggtttttgggttttttttaggtgaattcgagaagagataggaagatagcggttggacgcgcgtttaggttcgcgtcgttgcggatcgcggagttgtgtagaagcgcggtttggcgggtggtataagttcgatagttgcgtcgcgtagttcgttcgcgtttggttaagagtttcgcgagggtgtggggagaggatcggtttcgtagggagcggaggttgcgcggttgtatcggattttatagttttaagtcgcggtatgaggcgaattttgtaaagcgcgttttcgttatgtatcgttcgatttttagtattgtgcgtagtaggatttcggagtttattcgtttgtggaaatcgagttcgtagcgggaaggtagtgggtggagggtgggtaggtaggggtttggggttcgcggttttttattttcgcgttttttcgcgttagtttcgaacgtttttttggggcgtttttgtttagttgtttcggttgatttcgttttgtagttagtttgaggttaggcggtcgttttttgtaggttataaattttcggcgtaaaagtagggttttgaacgcgatatcgtattagagcgtttagttaagcgagttgtttttatttttattgtgtcgggcggcgtaaattgcgggcgtaggtagaggagtcgcggttttgcgtcgggcgggagtcgaagtttagagtttcgttagggttttttcgtcgagcgtatttatcgtcgttgaggtagagcgcggttagtacgaggattagtacgattacgattttggcgtttatggcgcgggcgggcgggcgggcgggcggacgagcgcgggtcgggggtcggacgtcgagcgggtaatgcggttgacggagagtgaaagtgcggcggtgggaggcgcgcgtcgggcgttttagaggggagagttaggcggggcggggcggggcgcgcggtgaggggcgggttcggagtcgagtgttggtcgtggtcggggtttttgacgcgcgattttttcggcggtattttttatttatttttttcgtttttttttcgttttttttgtgttttcgaggcgtagtgcgtttcggtttttgatttttttaggtttcgttgggtttcgtatcgttggttcggtttgtagtgaggttcgtagtttgagcgacgtcggttggagggtcgtttattgtttttgtgatagggttttattggagagattgaggattttaggcgtaaagtggggcgcgcgtggaaagttgcgggacggggtttttcgatggcgggaattgaatgagaattaatgaaaagtaaataagttagtttcgggcggagggtttgttggcggtggcggtttaaggtagtcgagggggttttgttttttgtgcgtgggggtttaagttcgttatttgttcggtttgcggcgtagtcgtcggtagagttcgatttgcgggaatgagattcgtttttgtagttagcgtggttcggattttaagtttacggcgttattagtcgagttttagttttttcgtttgtataaataaagtagaaggcgtcggcggtttttagtaaaagcgaatgtagtttttgtattttcgattttttaatggtgaaatgagttaattataggtttatttcgcggagtgggacgggagatttaatgagattcgttttacgtcgcgaaattttttgtatcgtgtttgataagtagatagtatttaataaatggtagttgtaagtaagttttttaaatttaagtatttattgttttatttaagaaaagtttcgtgcgatttaaagagttgagaatttttttatttcgattttcgatttttaggatagtattattggcgtttgttttttgggtttagaaaattttttttacggagtcgtttttcggcggtgtttagtttttcggatattttcgagatattttagatggttttagttcggtggcgaagggagggtgtaggtcggtatttaggagacgtgggggtgaggagagcgtttttttgggtttcgttttgtgatcgtaggttgttttagttatttttttgtgttttttttagtatagcgtttagcgaagtggggttagtcgtcgcgtttatttaggggtttgttttggggatacgtttttgtttttggggagttttggtcgtcggggagtgggcggttagcggttgtattaggcgggagcggttaataggaggttgcgagggtttcggaatttcgttggtgggagtaggtgttttttgtgtattttttttttaaaattattttggtcgttagatggttgtgggtcggtattttatttatttatttatttatttatttatttatttatttatttatttatttattttgggtattgggtttggagtcgggaattttattgatttggttttgtttttaaagaattgaaggtagtgaggtttagtgaagaaggtagtcgtcgggcgtttttaggtttttgttgggttgggtcggggagtttggtcgtttatcggtcgtagcgttggggtttcggcgttttttggtggcggcgttttttttttcgtttttagagttttggttagttttatttttgcgtagttgatgaaattcgggagggcgaaggggttcgcgggaaatttatattcgggtggaggggcgttttggagttcggagattcgattttgcgggagtcgcgcgtagtttcgtttgtttttaaatttggttaaagtaaacgttatcgtttttcgttttttttttttttttttttttttgttataaaattaggtgggtagttggatttaggatttgttttagaagtttgaaaggttcgcgtgggttgagtcgagggcgaattagggatttaggtttggtcgttgtttttttcgtaggcgttttgaggttttagaatagaagttattgtggtatttatggggttatttttttcgttagtcgttcgttaaatatttattgagtatttattatgtgttagatttgggttatatgtttgaagtagtttagaaaaggtattaaacgtttagaagtatatggcgttaagtataagtaattacgtataaaatatttagaaggttattaaatgttaggggaagatggagtagaggaaagtggggtgggagttaggattttaaatagggtggttaaggatttatattttaggtataagttttataattttataattggcgattgaaatttaaaattttggtcgggtacggtggtttatgtttgtaattttagtattttggaaggtcgaggcgggcggattacgaggttaggagttcgagattattttggttaatacggtgaaatttcgtttttattaaaaatataaaaaaattagtcggtcgtggtggcgggcgtttgtagttttagttattcgggaggttgaggtaggaaaatggcgtgaattcgggaggcggagtttgtagtgagtcgagatggcgttattgtattttagtttgggtgataaagcgagatttcgttttaaaaataaataaataaataaatatgtaaataaataaataaatatgtaaatatgtaaataaaataaaataaaattttgtatattttgggggttttcgtatcgtttgtataggtaggcggttattagattaggttattttgatatgtttttagtttattcggttataggggtattttttaaattcgggttagcgaagttttttatttttttttttgtgttttttgtttatgtttatgtttaaaaggttttatttttttttttttgtttggggatttttattttttatagagttttatttttttttgaagtttttagattttgtgtcgttttattaggtaatgtagggtatagcggttttttagggatgttttgttaagtatagtttaaggtgggaggtaggggtttggttgttgagttaaaggtagggtattttttgagttggtatgtgtgttatggtttttagatttttaggtagtatttgtttatttttttttgtttggtttgggtcgtttatttttttagggtttaacggttgggtttgtaagagggtttttagtagggattgaaggtttatattaaatttatgttgtatagtgtgtaattgataaggtgattttaggtggtattttgaaatttataaaatatagatttatgtatttatttttttaaagtaataagaaaaaatataattagtatagtaaaggtagatattttagatattgtttaggttttttttttaatatatggtttaagttttaaaaagtaagttaattgaagttaatatagtaagtgttagtttaggtggttggagatatagtaaaaattttgatagtaatataaatagatttgaaatttgaaaattttttttatatgaagaatattttttgtattatttgatatttttttatcgtaattttttttttgaaataagtatttggttttaaagtgttgaaatataaaattatataagggaggtacgatgttttttttatttgtttgttaggtgaggttggagaacgttggtttaggagcgtttaggttataggaagattgtggggttttatgggatttttggatatttttggttttgttatttttttaggagtgttttttttttagttttcgtgtagttttggagggattttttttaattatttatatttgtttttatttttttggtatttggttttggggtttaggagtagatggtttattttaggaattaggaagttcggtgaggaagataaatttttatcgttttgttgatgttatttgtgtagtaggtatattagttgatatggtggatttggttagtgtgaaattatttggtttagagaaggtttttaggaagatattgaatagtggatttatataggattttagtttgttttttttgaatttgttaatttggtatttttaaagatcgagtttgtagtataagttttattgttttagttttgaagatatggaatttaagtttttatgggttttgagtttaaggtttagagttgagggtttcggttaatatgatagagttaggtaggagtaagggtatatttttttggggttaacgtttttggattttggaatattagttaggttttgaaagtatttttggggatataagttatttttatggtagttatttagggagttttttggaatttcgtatttagggttaggatttggtatttgattagttggttatgttttttttgtttagatttttattggttttaagagttagttgtaaatagttttaggttgttttagagggaaggatttttgggaggtagagttgatttttattggttttgggtatatgtgtgggtaagtaaggtttatcgttagggtatgtgtacgtttagtaggttaggatttttgtttgagtaggttttgtttaaagatttttttgttggatagtgttgaggtagggggatttgagaatgtaagaataataaatttagtttttttttatttttataatataaaatatttttgtgattttagatgtgtgtgtgtgtgtgggggggggggcggggattttttatatataaagttagtagttttttagttgtagatattagttggttgttttttaatttaatttaattttgagatgatttatttggaggtaggtttaggttttatatgttgaggttttagttttataaggttgtttttattttagatattagttgtaagttttgggttgtttttttagtgtttttgattaaatgattataaattagggtttttatgattttatttttgggttttattaatttgttattatagtttatggaatttagggaagtatttatgtttattggtttattaaaaagggtattatgggttgggcgtggtggtttacggttgtaattttagtattttgggaggttgatgtgggtggattatttgaggttaggagtttaagattagtttggttaatatggtgaaattttatttttattaaatatataaaaattaattgggtttggtggcgggtatttgtaattttagttatttgggaggttgaggtaggagaattttttgaattcgggaggcggaggttgtagtgagttaagattatattattgtattttagtttaggtgataagagtaaaattttgttttaaaaaaaaaaaaaaaaggatattatgaaggttataggggaagagatgtatagggcgaggtatgggggaaggggatatgaagtttttatgttttttttaggtattattttttaggaatttttattgtcgtgaagttttttgaattttgttttgttgtgtttgtatagaagtttattatataggtatgattgattatattattggttattggtaatttagtttttagttttgtttttttttttagaggttgatggggtggggttataagttttcgttttttaattttgtttggtttttttgatgattagtttttattttgaagttatttaagggttgttagttattagttaagtaaattaaagattttaggagttgtatgttaggaagttgggataaagattaaatatatattttataatagtatagttggtattttttgggatatttttcgggattgtcggattattagggtttatagggtaaattagatttaaggttttaggggtttagatttgtgtttttagtttttatattagtttttaggaattaagtagtgaattttttttgtgtttagttattatagttaggtttggattttttttgttttttttttttagttttattttttttttttattttttttgtttttgggtagattggatttagtagttggggatttattgaaggtttttatattggagtatatattagtttttatttattagaaattttagagtgtgtatattgagagtgtgaatagtattgatattggagttattttgtgttgcgtgttttttgttatttttttttttgtatttagttgatgaggtgggtttaatggtaaggttattttttgaaataagggatagagattataaaattattatttgttagggatggagtttaaatttattttgaagtagggttgtttttggtgaaggagaaagagttggtttgttatataaaatatagtatgtttagttatgtttgaattttataaaaaagtaagggattttgtgtatttgttttttgtttgtttgtttttttttgtttttaagtattagtgtgttttaaatattgtatggggtatggggtatatttattaaaaagaattattagtgtttgtttgaaatttaggtttaacggagtattttgtatttttatttgtagagtttatgtttgttatattgttatagtttttcgttttgtggttttttgtttgaatttttagaatatgtggttgaggttgggaagggaagttatggagttattttttttttttattgagaggattttttgagttttattaatatagagatgttagaaagtggtgtatgaaagtaatataggaatgatttttttttgtttttttttttgggttgagtagtgtaatatagtatttgttttaattttatttttttagaaatagttttggttatgtttgaagtaagggtaggtaggttttttatttttaatattattagttttgttttttttttggtttcggtagatgtgtatgatgtttagttattgatattttttttatttattttaggtgggtgagttgtgggtggagaaggaggggagaaatattttagggaagagggttacgtgagtaatattttgggttggtgggattttgtaggagaggaaagagtttaagagttgttgtgggttgtaaaggaggagttgggtttgttgtttgtatagatggttttttttaattagaaaagttaggattttagttttattggttttttttgtttggaagaggagtttttatttttttttttattttatatttttgtggcggggtgtttgtagttttattgtatggatgatttgaattgggttgtatatagaggttattgagagaggtttttaaggttgagtgtaaatgcgggttttattagtagtttggtttaggggatgtaagtgggagatggatttaggtggggatatttttgaggtatttatttatttatttatttatttatttatatattaatttatttatttatttatttattgaaatatttagttatttatttatacgtttatttaatatatgtatttattcgtttatttatttatttatttatttatttatttatttatatattaatttatttattatttatttatcgaaatat

SEQ ID NO: 30 - DNA, 20506 bp, Artificial Sequence
  chemically treated genomic DNA (Homo sapiens)
gtgtttcggtgggtgaatgatgaatggattaatgtatgggtaggtgggtggatgaatggatgaatggatggacggatgggtatatgtgttggatggacgtatggatggatgattgggtgttttagtgggtgaatagatgaatggattaatatatgggtaggtgagtagatgaatggatggatattttagaggtatttttatttgagtttattttttatttatattttttaggttaggttgttggtgaagttcgtatttgtatttagttttgaaagttttttttagtagtttttgtgtatagtttagtttagattatttatgtagtaagattatagatatttcgttatagggatgtagggtggagaaagaagtaaaaattttttttttaaataaggagggttagtggagttggaattttggtttttttaattggaagggattatttgtgtaggtagtagatttagttttttttttataatttatagtagtttttgagttttttttttttttgtagaattttattagtttaggatattgtttacgtggtttttttttttgagatattttttttttttttttttatttatagtttatttatttgaaatagatggaaagagtgttagtagttgggtattatatatatttgtcgggattagaggaagagtagggttggtgatattggggataagagatttgtttatttttgttttaggtatggttaggattatttttggaagggtagggttggggtaggtgttgtgttatattgtttaatttagaaagaagaataagaaaagattatttttatattgtttttatgtattattttttagtatttttgtgttaataaaatttaagaaatttttttaatgaaaaaaaaaagtgattttataatttttttttttaattttaattatatgttttgaaggtttaggtagaagattataaggcggggggttgtggtaatgtgataagtatagattttgtaaatgaaaatataggatgtttcgttaaatttgaattttaaataaatattgataattttttttaataagtatgttttatgttttatgtaatgtttgggatatattgatatttaaaaataaaaagaaataaataaataaaaaataaatatataaaattttttgtttttttgtgaaatttaaatataattgggtatgttgtgttttatgtggtaaattagtttttttttttttattaggaatagttttattttagagtggatttaaattttatttttgataaataatagttttgtgatttttgttttttattttagggaatggttttgttattgaatttattttattagttagatgtaaggagaaaggtgatagaaggtacgtagtatagggtgattttagtgttaatgttgtttatatttttagtgtgtatattttggggtttttgataggtaggaattgatgtatattttagtatgagaatttttagtggatttttagttgttgagtttagtttgtttagaggtaaggggaataggagagaggggtggggttaggaaagggaggtagaaggaatttaggtttgattgtggtgattgagtataggaagggtttattatttggtttttgggaattggtgtggggattgggagtatagatttgaatttttggggttttgggtttgatttgttttatgagttttggtagttcgatagtttcggggaatgttttaggaaatattaattgtgttattgtgaaatatatatttggtttttgttttagttttttggtatgtagtttttaaaatttttggtttatttgattgatggttggtaatttttgggtagttttaggatggaggttagttattagaaagattaagtaggattagaaggcgggaatttatagttttattttattagtttttgaggaaggaaatagggttgaaggttaagttattaatgattagtaatgtaattaattatgtttatgtaatgagtttttatataaatataataaagtagggtttagagggttttacgatagtggaggtttttggaggatggtgtttggagagggtatggaggttttatgttttttttttttatatttcgttttatgtatttttttttttgtagtttttataatatttttttttttttttttttgagatagagttttgtttttgttatttagattgaagtgtagtggtgtgattttggtttattgtaattttcgtttttcgggtttaagagatttttttgttttagttttttaagtagttaggattataggtgttcgttattaagtttagttgatttttgtatatttagtagagatggggttttattatgttggttaggttggttttgaatttttgattttaggtgatttatttatattagttttttaaagtgttgggattatagtcgtgagttattacgtttagtttataatattttttttaataaattagtaaatataagtgtttttttgagttttatgagttgtggtagtaaattaatgaaatttaaggatggggttatagaaattttaatttatggttatttggttagaagtattgggaaaataatttagggtttgtaattggtatttgaagtaggggtagttttgtgggattggggttttaatatgtggggtttgagtttatttttaggtagattattttagagttgaattgaattagaagatagttagttggtgtttgtagttgaaggattattggttttgtatgtggggaattttcgtttttttttttatatatatatatatatttgaagttataaaagtattttgtgttgtgagagtaaggagaaattgagtttgttatttttatatttttagatttttttgttttagtattgtttagtaaggaagtttttgggtagagtttgtttagatagaagttttggtttgttagacgtgtatatattttgacggtaagttttgtttgtttatatatgtgtttagaattagtggggattagttttgttttttaggggtttttttttttagggtagtttggggttgtttgtaattggtttttgaggttagtggggatttagataggaaaaatatggttagttggttaaatgttaagttttggttttgggtacgggattttaaaaggttttttggatgattgttatgggagtgatttatgtttttaagagtgtttttaggatttggttgatgttttaggatttagagacgttggttttagagagatgtatttttgtttttgtttggttttgttatgttggtcgaggtttttaattttgagttttgggtttagagtttatggagatttgggttttatgtttttaaagttgagatagtggggtttatattgtaagttcggtttttgaaagtattaaattgataaatttaaagaaggtaaattaaagttttatgtaagtttattgtttagtatttttttaagggttttttttgggttaagtggttttatattgattaaatttattatgttagttaatgtatttgttgtatagatgatattagtaaggcggtgaggatttgttttttttatcgggttttttggtttttggaataggttatttgtttttgaattttagggttaggtgttaaaggagtgagggtagatgtgggtggttgggaggggtttttttaggattgtacgggagttgggagaggagtatttttggaggggtggtagggttaagggtatttagggattttatagggttttatagtttttttatgatttgagcgtttttggattagcgttttttagttttatttggtaggtaagtgaggaagatatcgtgttttttttgtgtgattttatgttttagtattttggagttaaatatttattttaagagggggattgcggtgggagggtgttaagtaatataaaaaatattttttatgtagaaaaggtttttaaattttagatttatttgtattgttgttaaaatttttgttatgtttttagttatttagattagtatttgttatgttagttttaattgatttattttttaaaatttgaattatatattaaaaaaaaaatttgagtaatatttgaaatatttgtttttattgtgttagttatatttttttttattattttaaaaaaataaatatataaatttatattttatagattttagagtattatttgaagttattttgttaattatatattgtataatatggatttagtgtaaatttttaatttttattgggaatttttttgtaggtttagtcgttgggttttggaggagtgaacggtttaggttaggtagaggggggtaggtagatgttgtttaggggtttagagattatagtatatatgttagtttaggagatgttttgtttttaatttagtagttagatttttgttttttattttgaattgtgtttaataaggtatttttgaggagtcgttgtgttttgtattatttggtagagcggtatagagtttgaagattttaggagaaggtggggttttatggggagtaagagtttttaggtagagaaagaaaggtggagttttttgagtataagtataagtaaaggatatagggaaaggggtggggaatttcgttgattcgaatttgagaggtatttttgtggtcgagtgagttggagatatgttaaaatggtttggtttgatggtcgtttgtttgtgtaggcggtgcggaggtttttagagtgtatagggttttattttattttatttatatatttatatatttatttatttatttatatatttgtttatttatttatttttgagacggagtttcgttttgttatttaggttggagtgtagtggcgttatttcggtttattgtaagtttcgtttttcgggtttacgttatttttttgttttagtttttcgagtagttgggattataggcgttcgttattacggtcggttaatttttttgtatttttagtagagacggggttttatcgtgttagttaggatggtttcgaatttttgatttcgtgattcgttcgtttcggttttttaaagtgttgggattataggtatgagttatcgtgttcggttagggttttaaattttaatcgttaattgtaaaattgtgaggtttgtatttaaaatatggatttttggttattttatttaaaattttaatttttattttatttttttttgttttatttttttttagtatttaatggttttttaagtattttatgcgtaattatttatgtttagcgttatgtgtttttaaacgtttagtgttttttttaaattattttaaatatgtagtttaggtttagtatatagtgggtgtttagtaagtatttaacgaacgattagcggaagggatggttttatgggtgttatagtagtttttgttttggggttttagggcgtttgcgggaggggtagcggttaggtttgaatttttggttcgttttcgatttagtttacgcgggttttttaggtttttgggatagattttaggtttagttgtttatttgattttgtggtaaagaaaaaaagaagaagaagaagcgagaggcgatggcgtttgttttggttagatttaagggtaagcgaggttgcgcgcggttttcgtagggtcggattttcgagttttagggcgtttttttattcgggtgtagatttttcgcggattttttcgttttttcgggttttattagttgcgtaggaatggagttggttagagttttgggagcggggagggaggcgtcgttattagagggcgtcggagttttagcgttgcggtcggtgagcggttaggtttttcggtttagtttagtaaaggtttggggacgttcgacggttgttttttttattggattttattgtttttagttttttaagagtagggttaagttagtggggttttcggttttaagtttagtgtttagggtgggtgggtgggtgggtgggtgggtggatggatggatggatggatggatggagtgtcggtttatagttatttaacggttaaagtggttttggaaaaaaaatgtatagaagatatttatttttattagcggagtttcggagttttcgtagttttttgttgatcgttttcgtttaatgtagtcgttgatcgtttatttttcgacggttaggattttttagggatagggacgtgtttttagggtaggtttttggatggacgcggcgattgattttatttcgttggacgttgtgttgggaaggatatagagaggtggttggggtagtttgcggttataaagcgaggtttaaaggggcgttttttttatttttacgttttttgggtgtcgatttgtatttttttttcgttatcggattggggttatttgggatgtttcgggggtattcggagggttaagtatcgtcgagggacggtttcgtgggaagagttttttggatttagaaggtagacgttagtagtattgttttaggagtcggaggtcggggtgggggagtttttagttttttgggtcgtacggagttttttttgggtaaggtagtaagtatttaggtttaaaggatttatttatagttattatttattgagtattgtttgtttgttagatacgatgtagagaatttcgcggcgtggggcgggttttattgaatttttcgttttatttcgcggggtgggtttgtgattagtttattttattattgagaggtcggaagtataaaggttatattcgtttttattgagagtcgtcggcgttttttgttttgtttgtataggcgaggaaattgaggttcggttggtggcgtcgtgggtttggagttcgagttacgttgattgtaaagacgggttttattttcgtagatcgagttttgtcggcggttgcgtcgtaagtcgggtaggtggcgagtttgagtttttacgtatagaaagtaggattttttcggttgttttgggtcgttatcgttagtaggtttttcgttcgggattaatttgtttgttttttattggtttttatttagttttcgttatcgaaaggtttcgtttcgtagttttttacgcgcgttttattttacgtttaaggtttttagtttttttagtggggttttgttatagggataataagcggttttttagtcggcgtcgtttaggttgcggattttattgtagatcgggttagcggtgcggggtttagcggagtttgagaaggttaaaggtcggagcgtattgcgtttcgggagtatagagggagcggaggaggggcgaaggggatgggtggggggtgtcgtcgagggagtcgcgcgttagagatttcggttacggttagtattcggtttcgggttcgttttttatcgcgcgtttcgtttcgtttcgtttggtttttttttttaaagcgttcggcgcgcgttttttatcgtcgtatttttatttttcgttagtcgtattgttcgttcggcgttcggttttcgattcgcgttcgttcgttcgttcgttcgttcgttcgcgttatgaacgttaaggtcgtggtcgtgttggttttcgtgttgatcgcgttttgttttagcgacggtaagtgcgttcggcggggaggttttggcgaggttttgggtttcggttttcgttcggcgtagagtcgcggtttttttgtttgcgttcgtagtttgcgtcgttcgatatagtgggggtggaggtagttcgtttagttgggcgttttggtgcggtgtcgcgtttaaagttttatttttgcgtcgagggtttgtgatttgtagagagcgatcgtttgattttaagttggttgtagagcgaggttagtcgggataattgggtaggaacgttttaagagagcgttcgggattggcgcgggaaggcgcgagggtggggagtcgcggattttagatttttgtttgtttattttttatttattgttttttcgttgcgggttcggtttttataggcgaatgggtttcgaggttttgttgcgtatagtgttggaggtcgggcggtgtatggcgagagcgcgttttgtaaagttcgttttatgtcgcgatttgaggttgtgaggttcgatgtagtcgcgtagttttcgttttttgcgaagtcgattttttttttatattttcgcggggtttttggttaggcgcgggcgggttgcgcggcgtagttgtcgggtttgtgttattcgttaggtcgcgtttttgtatagtttcgcggttcgtagcgacgcggatttgggcgcgcgtttagtcgttgtttttttgttttttttcgggtttatttgagagaggtttagggatttttcgagttttatacgttttttttttagttttttaaatatatttgtagataggtttttttgttattagttggttaagcgttttgttttagaatgagagttgtagtaaagtttaatttttaaggttttgggttattgggaatcgtggtgtttcgttttattgggagagggttttttttttttttttcgttgaagagaaattcgttgcgttgttataggatatcgatgtaaattaaaataaattgttgtttttgaatatataaaataaaattttgtggtttaggtcgttgagtttttttggttgtgaagttttttgtaaagagttgaaggatattttgagtgtttttgtagtcgcgggttgtgtaggtttagcgcgtttcgagtttttggttgggttggtgtagacgtggtttcggcgttttagttggtttggattgtgcgttggtgtgagtaggattagcgtagttgagtcgggttggagaagttgggtagtttggggtcgtggcggattgtttaagtgttaaggatatagattgaaggtaattgggaatgttcgtcgttgatgaaaagtttttgaggttgtgtttgtatattgattttttttttttttcgtaagttatggggtatgtttttagtttttattgttggatatttttttgtttttgtaaggtttttggtttgggtagttattgattgattggtgggatgagcgcggaggtgttatagtgcgtcgttttgggaaatggtgttgtttttttttcggagggttggagagaggattggaatgaggaatttcggtttttgagttatgggtgtaattgatttgggggaagtatagagacgtggggtttattttagattttttttggtttgggaagggtgatatggtttttagagttgttttattggtagttaagtaattagggtaggagtttgggttttaggtagatttgttttttatatatatcgttagaatgttttgttttgttttgttttttttttattttatagtgtttatgtgttttttatttttatatttagtttttaagttgtattatagagagagtttggttaggggttttgttttttttttattggttgattttcgttaggtagttgggtttttgggtttttcgggtttaaatttagggtgggttttttttttaagtttgtttggaggggttagttgggtttttgtttttgtattagattggagggttttttgaaaatttttggagttaagtttattcggttttaaattcggggtattattagagttagttaggatttttgtcggtatacggatttatatttagaacggttgggaaagttagttttattgataaaaagttggaggaaggagtatatgaggtatatacgagattatgtttttttggtaagtatatttgggggttttgttattttaaaaagatttgttgaaattcgttgtttgataggcgggttttaggttttgggagtagaagtaagaattgtttttgaaggaaatggataattttagggggtggagggggagaggagagagagtttgtgtgttgagttttgaataggttttgatttttggttttattattattgtttggttggggggttagaggagttttttttttttgggcgttggagagttatagttttatttattttagcgggggcggttgtagtatttgtttttggttgtatatttttaagtttattgttgtcgggagggggtttgtgttttattatcggttttttatttttttgttttatttttaatttattttttgttttagtttggaagggtttaaaagaaatttagggaaatttggaggtataatatttaggagcgtttagttttttagttatttaggttgtaggtttcggttttgggggtggtttttttaggtgatttggttatagtgtagtgttgattttttttgtagggttttagtgtagttgttggaagttggttttagaggtgtttttttggagttagattaggtgtaattgtgaaggttgttttaggtttttttagtgttatgagttattagtattttgatgtttggtttttttttggtttttagggagttgtatttggttttggggataaggaagtggggggataagtggtttattttttttgtaatttggtggttgaatatataatgtaatttttagtttatattattttttaattgattgtagtttgtagaaaaaataaaataaaatgagttttttatttaagatttttttttatttttttagtatttttttttaaaggtgtagaattttagaattatagaggttttttagaattttgtaaataggtaaatttaaaaaaaaagaaaaaagaaaaaaaatttttggattaaatatttttagatatatatttaatttttgatgaaaggatttataagtttaaataatttggggtattaagtggggtttggataaaatttttaaggaaaaaagaaaaataaaaagtatatataaattttagttttttagggtttgtaattttatatttaaagggtgagtagtgggttttgtaggagttttttgttaatttatattaatgagtgttaattatggtattttgtaaattggtgattttgtaaagattttaatataatttttgaggttatagtatttttgtttaggtaatgaaaattatatttaattttagttttattaatttttaagttttggggaaagtgttgggtagaaggtgggtttttggtttgtttttaggggatttataggtaggaagttagttaggatttttttgtgttttttagagttttaggtgaatgtgaggaggggtttttggggtgggggagggtagtatttttgagtattattgtgttttttggttagaggtttgtgttagaggagagaggttagggagtttggagttttttgttttttttttttttttttgagtagggagattttttttagttgttttttgaggaattttttttataaagagtaattggaaattttagtattttggattgaaatcgttatttattataattattatttttattttgagatattgagtaggtggtttttaatttaaattttcgttttatttaggtttcggttttttttaggtttgttgggttttttgttttgtagaagttgagtttgagtttagttagtatttattgtgttgtttgaggagatggttttttttaatatatattagtaatttggaatttattttagtgatgtcgttttttgatttttaatcgttgtattaattgttgtagtttagatatatattattaaaatttggtagggtagtaaagtgttttgttgtttttattttttttagggaagttcgttagtttgagttatagatgtttatgtcgatttttcgaaagttatgttgttagagttaacgttaagtattttaaaatttttaatattttaaattgtgttttttagattgtgtaagttttgaaattgaatattatttaacgaatatagttgtatttaacgaatatagtaatatttaattcgagttttattaaaggtgtagaggtgataagttaagtgtttaattttgaatttggtataattagtggtagttatttttattatgaggatttttagtatgttattaggtattaattttaaaagtcgtttttggtttgggtattttgttgtgttcgtagtagtttttttttttttttaaatttgtgttttttagtatagtatagttggatgttggagaaattatgggttttattaaggttttggttgaagtttagtaaattagttagtttttagttaataatagtgataattggtttgttagtttcggggatttgatgttttatattaatttataagatttaaatgtagtttaagttttttttaattattgggtgaaattttaatatttttagtttatttgtttgtatttttttaagtataatatatgaggttttggtgttatttggtgtggatggtagttattaatatttgattttatttatttgggaaataaagattaaaattatatatttataagataggaagattttagttgggtatagaagatcgggagaaatgcgggaagaaagttatgtgtttgaaagtttttttatgtttaagaggttttgtgtttgaatacggggaagcgagggtttagggagttttttggagaggatttgattgtttagaagttttagtgttaaaaatggggtggggagatagtagttggaattaaagttataatttttttaagatttttttatttaatattaaatgtttttatttttgattttagaaaattgtttttagttttgagttaattttttattgttttgaatgtgtttgttatttatagtatgttttagggttttagaaaatgaatgttttttttgtattttgtttataatatgatattttattttttgtgaagagtattttaaagatgtttaatttagttattttggatttgttttatagtattgattatgttggtttattggtttggaaatgtattttgaagttgaagatgttaaatataatttttaggtttgagtagatattaaattaataaagaataggttttagatttggattttaatgtgggttgtttcgagttatatttatttttgtatttttttttatttaatggataggttgtttgaagattttttgggtgtttttgaattattgttttggggtttagttgtttttaagatttttaagtatttgggttgtatgagattatttggtattaaagggttttttggtaagagatttagagagatgaaattaggttttttttaggagtttgtatgtagggaagtttttaagagtgtgaatttttaaaaaataaatgagattaagaaatatttagtgaatttgtaaaatttttttagaaattattttttggtaagttatttgtattgttttttttttttttggttggttattttttcggttagatcgcggtgatttttggtaggttttttttttttaggtttttttatgtttatttttaagtcggttttatatttattaagatgatttatttaaataaatttttgttttgttgttttttatttttttttttttaggtatttagagtattttgtcgtttttttttttagttttttttgtatgttttgatgatttttttggcgtatttgtttttgatttttttttttcgtttatttattttttaagtttttatttattttttaaaggtagtttaaatgtttttttatatgaatttttttgtattgtttcggaaagatttttgtttatatttttatgtttttgtaatggaattttttgtattgttagcgttgagttttttttagtatatcgcgagtatttttggagtttgagcgtattaagtggagtacggggtgttagcgagggttttagatgggtgttgggggagcggatgtatacgttgtagtcgcgttttttttttgtgtagtcgtatattgttgttattttgtttttatagagttcggttgaagaataataatagataagtgtgtattgattcgaagttaaagtggatttaggagtatttggagaaagttttaaataagtaagtataatagttaaaaaggatttttcgttagatttattcgaggaaaattaaaattttgtgagagatgaaagggtaaagacgtgggggagggggttttaattatgaggattaggtgtgtgtgtggggtgggtatattgatttgggatcgggtttgaggtttgttagtatttagattttgtatttatagtatacggtatgatattgtagtttatatttatttatgttttgtatttgtgtacgttggaatttttattattggggtttttttaagaaagaaattgtattattaatagtatttttaagtagttagtttttttatgattattataattattattatttttatttttattttttaaattaacgagtattttaagatttgaatttggtttgtttggagtattttttttgtttttttggggagtttgggtatagttaggtggtggtttaatagggagttggaaaaagtgttttttttttagatattgaggttttcgtagtagcgttttttttaagaggaaggtttttgtggtatttagatatcgattggggttgggcgtcgttattgtttttatttttttttttaattttagtgattggttttgtgggttttatgtagaagttattattattgggattgtgtttagagattttttttttagttatttttatttttttttcgatttcgagagtatgtttaattttgtttttgttttttatttttgtagtttgattagcgtcgtattagtcgggaagagggtgattgttggggttcgtgttttgtatttttttttttttagggtttgttttatagttcgggttttttgtgagattcgtttttggttttttttagaatggagttggtttttttttggggatgtgtaatggtttttttgtttattcgtaaaagataagtttttatagaattaaatgtaattttaaatttgagagttcgttttgagtgattgggttttgtgattgtttttgaagtttatgtatgttatggaggtattaataaattttgaggttttcgaaattagaagcgaaaaaattagtgaataaattattattttgttattatttttttttgaagttatagtagggttttaggttttaattagaattgttggtaaggtgatatttttatgtataaatgcgatttatagaaggttttggtggtatttgtaattttttgtaaggtatttttttatatatatttttgtgtatatttttttttacgtttttttagaaaataaatgtattttaaaatatatttatagtcgaataatttatatatttgaagtggagttatatgaatgttagtagtttatatttttttattattttaaattattggtaatttgtaaagaaatatatatgatatataaatgtgattgtagttttttaatgttagttatagtgtatttttttatttgtattaaaattgtattaaatgtgatattatatgtattagtaataaaatgttaattgttttatggtataaacgttttattgtatgtgggaatttatttatttgaaataaaatttattagttgttagtgatggagtttatagacgtttttggtttatatagttaagtttgtttgtagttaggtgtttgagatttttttttatagtttatgtgtgatagtgtatgggttttttttacgagtagattagatttgtagtttaagtttttggattttttttttttttttttaattcgattgaaatagtagtgttggttttttgaagaataatatttgatttattaattcgttttttttttttttttttttttggtttttttaatttttttatgtaatttttagagatttaattttagtaatattaattttttatatttttttatgtaaaaattttatgattttaggttatggttaatatgaagtttttatagggataggtggttttattttataaattattaaatattatttagtttgaattattttaatgtgatagttacgagttagttgttttaataaaattttgttaattagtttttttttttgttttttagaataatcgtatttatttttaggagtgtttataggcgtttagaaaggggaaggtgggattattgttttttttttttttttttgaatggtagtttgaatttggggtttgtagtttttaaaacgttatttaatttgaaatgtagatattttttagagaaagttaagagtttagttttgtattgagaagaagaaaaagttttatgagaatagggtagggtggggtgataaggattacgatggttagtttggttttgggtgtattttgagatgtggattttttgtttttagtgggaattaggtttaggttggtagattggtagtcgttgtaatttatttataaaggtgttttaggagtttattgaatatttgtttgaatggaaggaaatgtttaatttattttaatgaattattgataaatagtgttttgattaggggtttttaggtttgagattgaaggtatagtttaattagtatacgggttagtgttaaattttatgtagattgagacgaatttttgtttatttttatattattaatggttttattaattttatttaagggggcgtagagaagaaaaagtggggaaaaaagaaaagataggaaaaaagaagcgatagaagaagagaaaggttgtttagaaaaggaaaaattagttatttgttatttcgagatggattatagtttatttgttttcggcgttttgtaaatttgttcgatttttttttaggatagatttttatgtagattgggtaggggtttagattttcgtgggggagtagtgttttgttgttttgttagttatatcggtttttgtatttatgtgttttttaaggtttttgttggtttgttaagttatgaagaaagtagttgtgtagagattggggcgggggtttgtgacgcggagtttgtgtgtttaggattttgtttagaatagtttgggagttttaggaatgtttaggttgttgagttttttagttcgttttttatttttttttttagaaggtttgcgtttattggggagtttattagttttatatatttgtagtttgtatttttgtggagattaggttgtggttatttggttagtgtgtagggtaatttgttagtagaggtggtttcgttaggaagggggtgtgttatttttttgtggtttttaggaaaggtgaaaattgattgatttttaggaatgggttttggttttttttaaatatttattgtttttttttttagtattttgttatttgggaaggggtttttttagttttttttttttgggttgtgggagtggttttatttttaagttcgggtgggtttttgtaaattgtgtggggtgagttcgagggaatgttgtatttttagagagtagatgtggaaatattttttagggagtttttttttgggtaattttttttagagtttttaaacgggttttttacgtggaggatagatgtgttatggaattttgtaagggttttgaatttttggggattttagtttgttttttttcgttttttgcgtgatggcgtgtgttttagttgtagggtatagttgtttttgtttttatttatgggaaatattttatttgtttaaagtaaatattatttaagttttaggaatttttttgtattttttttttttgtttatgtagatgtatgtgtgagattttttggtaagtttttttaatttggatcgggaggatggaagagtaaggattttattttagtagtgttcggaaaaaggatgcgttgaattttttagtttttttttattttatataaatattcgtttattttgtattcggattttgggttataattttaataaatgtagaaagagaaagtggttggaggatggagtatatggaatttaggagaaaatttataaagatttttgtatgttagatatattttgtttcggagcgtggtgtttttttgagttttaatgagttttttgtgattatagttatgtttttttttcgttggggaggtgttttaggatgttttagttaaagatttttgtttttcgttgttattttttttatttggataatttttttggtttacgttttttttgttagtattgggggttataggtttgagttttgggtataggggtgttttagttttttgttttttttattttttaaggtatagagttgttgggtgggttgtttggggttgttatttttttcgtggaagttagtagttattttagtttatgggatttttgataaaagcgtttcgagagggtaaatttgtgtttttatattcgtttgtatttttcggattttatatgtagtagggttttgtgtttggggaggggtggttagtttgttttggttagtatgaaaagttgttggttttttagggatagagggtttagttaaggttgtttgaggatataaattgtttgttattttatttttggggagtagggtttgtagggattgagagtgggttttattttgagaacgtatgtaaggttcgttttgttttgatgttttgatgtgattgtatgtgttttgggggtttattgtggtttataagtggtttgtgaagtttttgggagtaggtggtatatttagtgttgaagatagggtcgtcgtggaagagtgaagagtttgatcgggatttttggtgggttgaaattaggaagtgtttatattagttagagttaaatgaggggtgcgttatggttattgttttgtttagtatgcgttttttttgggaggttttggttatttgtgtatttatttttgtgttatttttagtagttttatttggggttatttacggtggtatggtttttggttgagaggtttcgagggcgaagggttattggaagttacgaaagtgttttttgggatagtcgaggttaggatgtagggtagtagtattttgagttttagttttacgtcggtgtcgggtaagtagtgtgttttgttttcgtcgtatgattattttgatgggtttttttgtgttttcgtgcgtttgttacgtttagtgtttgttacgtgtttgttttttgttttttgttatttatgggttttttcgttttagtttggttgcgtttcgtatttttttttcgtttgttgtcgtagggtttttgaagggagatgtatggttaaggtggtaatttggaagtagggattggttttagggttttcgcgtaggtcgttgtttttttggagttggttgggtgtggggggaatttgttttaatggtgtttttttttgtttttgttaataggaggtttaagatgtgagagggttagacgtttgaggaatttttatagtaggagtttagttttgaaattagtgttagggaagggtttgttatagttttttttgttagggtagggttttaggtattgttaagggttttgttttgtatattttgttatatttttattatttgattatgtagtaaaatatatgatatttattttttatttagtttgattatttagtgttattggcgatacgtagtagtttagattaaggttattattgtatttgttttattagagtgtttttttacggagttatttttttgatttagggtttttgggttttgtattttttgagttgtgtaggtggggagattgggttgagggagtttggttttatggttagttttagggtggagagttattaagagggacgtttgggggtgttaggattagttaatttgggtaaagtttagtgaaggtttttttttgtgggatgggatggtggagggttatatgggaggtttatttttttttttatttatatgggagtcgggtttgttttttttgggagggtagtagggttattttgagttgaggtagtagtgtgaggttagggtagagtgagatttagtttttatttcgagtatttttatattttttacgttttgtttattattttttgttttatttattattatgtgtgtttacgattgtttttatggttttgtaaaaggatttttaggattaaagtttttatgtaaattgtgtattaagtaggaaatgaaaatgttttgtgttatttgaaaatattgtgtatatttgtgttttgtttggaatattgtttattgtttaattttatgtttttgtttaaagttagcgtttttttttgtgattaatgttttgatgtatgtattgttttttttgtgtagtcgttgagcgaggagatgttttttgggttttttgagtgtagttttgattagagtcgtggttttttggggtgaattattttggtttttttattgattataaaaatatggtgggtttatgggtagagtttaagggaattcggtgtgtattagggttgattttagaggattgttgttttattagtgtttttttatatgttagtatttttaaattagggttaagtttagtattgtttgaggaaaataagtatttataatttgtttttggtttttaaaatttagtttataaaataattaattttggatatgaagatttttttttaatttatatttaattttattttttttattatttggtaatgttattattttttgttttttttttgggttttttttgttttgcgtgttatttgtgtttcgggttttttttataggatatttttttaagagaat

SEQ ID NO: 31 - DNA, 30068 bp, Artificial Sequence
  chemically treated genomic DNA (Homo sapiens)
tcgaatagaatgggtttgtgaggttggaaggaggtattttttttggtttaagaattatttgttttgtgtgggaagagattgatgggtggaagttttagtgggggagtaggtgggagtgattgatgagaaggagaaaaattggttgtgggggatagaaattggtatgttagttgtttgtttagttattttattagtataagtatagatgtgagagatagaagttggaaagttagttgtttgtttagttattttgttagtataggtattgtttagagtaatgggatttgatgatttttgatggtttttgtagtgaatgattttagttttttttgggagtaaagcggttttgagtagagtttttattaaggaggtattaaagatggaggatttttgtgtagtgaggaaattttttttagtttatatgatcgtatggtggggtagaatatgaaaggtatatttagagttagtataaatattgatgtatagtttttttgtattagtgagggtttgagttaaggtaattaattcggtttgttgagaggtagtggagggggtagagcggtagttttaatgatagatgtggaagatattatagtatagtttgtttttgttggtgagtggcgattaggtttggtggaattgttattaataaattaaatgtgattagggtgaggaataggaaagaaggaaatgtggggaaatggggtgaatgttaggtggattagagagatatagttatgggggttaggtgtggtattcggaataatgtgggaggtcggattgaagtatgggttagtaataatggtgattgtgggagatttaataaagagtgagtgtagttgaaggagtcgggaagtagaaagtatatgcgttaggtgtgaggaagaaaatagatttttggaagttatgagaattgtagagagtgagttgagtatagtttgtgattttgagggtttttaaaattattaaagtagcggtagtcgttgtttatagatatgagggttaggttaaaatagtaaggttaagttgttcggatagaaaggttatagggtgcggttttggtttttgtgtaagagtttcgattacgttaattatgtttaggaaggaaaggagttgttgttttgtagaaggtgttggggtttgagagattagttagatacgatcggtatggagagtacgtgtgtttttatgagaattatgtcgagataggtaatagaggaggaagaaatttgggtttgattgaagtaatgggggttgtttgtgaagttttgcggtagtatagtttaggtaatttgttgagtttgatcggtgttagggttagtttaagtgaaagcgaagagaggttgggatgaagggtgtaaaggaatagtaaagaaagtacgtttgagatttagaatagaataatgggttgtagaggtaggtattgaggataggagagtatatgggtttggtattacggggtggataggtaaaataatttggttgataaggcgtagattttgaattaatgtgtaagttttgtttggttttaggataggtaaaatgggagaattgtaaggggagtttataggttttaaaaggttatgttgtagtaggttttaatttttttaaagcgtgttgcggaatgggatattggcgttgagtggggtaagggtgattaggttttaatgagatggtaaggggtgtatgatcggttattaaggagggagtagaggtattttatatttgtgggttaaggtggggggatgtaagaggaggaagtaaaggaggttttggattgggaagaatggtagtaatgagatatagttgtagtttaggaatagttagggaagtagataatttagttaaagtgttttagtttaataagggaattgggtaggtggggataattgaaaaggagtgtttgaaagagtattgtttaagttggtattagagttggggagttttaagaggtttagaagtttagttgttaatatttataatagttatggaggtaagggaaataggtttttgaaaagaaggtaatgtggagtgggtagtttttatattgattaagaaggggacgggtttattttttattgtgagagttatttagattgtgatggttttgtaggtttttgaggcgatcgggatcgggtagtgttagtttttagttgttaagtcgagaagatttgggaaggagttagagagttttgggttagagttttagttgttttgggagtggttgttaggtgagttgaatagttcgatttttagtggggtttcgtatagatgggatgcggtttaggaggaattttaggttgtggatattttttggtttagtggttagatttttagtatttgtagtaagtttttgggggaagaggttttggaggaatttttggtagttgcggtttaggcgtttggagttttcgtgtgttggagatgtggttggggtttgttttatttggatattggagtggaggtaaggaattgtaatttagaaatatgttgttatttggttgtttttattttattattgtatattttgaaggcgaggttaattaagttttgttgtggggtttgagggatagaatttaatttttggagttttatttaatgttgggagtagatttggtaataaaatgtatattgagaataagacggttttttgatttagggtttagggttgtaaagcgttttagggttgttgttaaatgagttatgaattgggttgtgtttttaaatttgatgaaaaagagtttaaatattatttgatttgggagaggttagataaagaaaaaggagtattaattttgattatgtttttagttttagttatttttttaagaggaaattgttgggtagttgggggagggttagttatggaatggaattgtaagttggatcgggtgtgaggaggggaggtgataaaaggattatagggtggaggagcggaggttgaggaagaattgggatttagttcggtttggcgaggaggggagatgttagatgggtttgtagaaaaggaagattagaaagatttagcgatgtttggggttgggattgacgggataggcgggagggaaagaaggaagatttgggacgagttgtattgggtatagagattagggagggatcgatgtgtaaaagaatgtttggatgttaggtattttagattatttgtttattttataataagaattatttagattttgtaggatggaaaaattgaaagtgtcgttttttggttatttggaattattgttaagtttgtattggggttaagtagtattgtagaagaaaataaggtatttaggttttaggttaggtgtgagttgaagaggttttaggtttttaagaatataggttaagggagaagaaggaggaatggagggtggaaggttgtttatattgaaggaggtaagtatagagaaaagagagagtagagatatggagggaaggggtttaggggtttttattttttagaaaagcgggaaaggggttagggtatagaagtaagggattggggtgtagagataagaggtcggggtgtggaaataagggatcggggtgtagagataagacgttagggtatagaaataagggatcgggggatttttgttttttagaaaagcggtatttgttattaagggtgaaggagaaggggttggggggtttttgtttttttagaaaagtagagaaggggtagagatatagagaaggagttgggggtttttgtttttttagaaaagtagtatttgttattaagggtgaaggattaaggtaggtatttttatgtggttagatatttttgaaacgtgggtgaataattagagaggtgtttttgcgtgattaaatattaagggaaggttgttttttcgagtttatgatcggcgttggagttttgggtttacgaataaagcgcgttttttgtttttattagaaaaggaaaggaattgaaattaagagaagggagagattgaagagtggaaaggagaaagtggttgagggatagtgagagaggttggagaagagagtaaaaagaggttgtttattggatttaaaattggtgagatgttttttgggttggttggtttgaggacgagaggtcgtaggtggattttttttatggagtaaagagtaggaggataggggattgattttttaaggaagattttttgattcgagttatggtattaaattttatttacgttcgtgtgaagagattattaaataggatttgtgtgagtaataaggttgtttattttatttgggtgtaggcgggttgagtttagaaagagagttagtaaagggagataggagtgcggtcgttttataggatttgggtaggtaaaggaaaattatagttaaaagggggttgttttttggcgggtaggagtggggtttataaggtgtttagtaggggagtttttgagtcgggatgagttaggagaaggaattttataagataatgttattatttaaggtaagaataggttatttttatttttttcgtggtggaatgttattagttaaggtaggaatcggttatttggatgtgtatatataggttatagggggatatgatggtttagtttgggtttagaggtttgatagtttggattatttgatttggtgattcgtatatttcggttttttaaagtgttgggattataggtatgatttattgtatttggttttagaaaattttttaaatattaaaatgtatgttatgtgtattttgttataatttttgaaaagtattttttggtgtttagagatagaagatgagtggttgtttagggtcgggagagtgaggggatcgtggtgatgggtagttggtcggtatggggttttgaagggtagtgatgataatattttaaaattagattgtgttgacggttgtattaatttcgtgaatattataaaatttaaattattgaattatgtatttttaatgggtaattgtatggtatgtaaattatattttaataaagttatatttttaaatattaaaaaaaggtcgggtgcggtggtttacgtttgtaattttagtattttgggaggtcgagaagggcggattacgaggttaggagatggagattattttggttaatatggtgaaattttatttttattttgaaaaaaaaaaaaaaaaaaaaaagattattcggacgtggtggtgggtatttgtagttttagttatttaggaggttgaggtaggagaatggtataaattcgggaggtagagtttgtagtgagtcgagattgcgttatttaggaggttgaggtaagagaatggtataaatttcggaggtagagtttgtagcgagtcgagattgcgttattgtattttagtatgggtgatagagtaagagtttattttaaaaaaaaaaaaaaaaagattagtaatattttttgtgttatttattatttaagtgattgaattacgatttgaaatttattattttaaatatggtttagagtttgtagaggggggatagttttaggaatgttggtgtgggtttaaggttgaattaaatagatttagatggtttatatttgtaattttaatattttgggaggtcgaggtaggtgggaggttgaggtaggcggattattggagtttttggagcgaagaaaggatgttagtggaaaaattggtgaaattagaataaagtttatagttttattttttaaaggaggttgggcgtggtggtttatgtttttaattttagtattttgggaggttgaggtaggtggattagttgagtttaggagttcgaaattagtttggttaatttgacgaaattttatttttattagaaatataaaaattagttgggcgtggttgtgggtgtttttaattttagttatttaggaagttgaggtaggagaattgtttgaatttaggaggcggaggttgtagtgagttgagattatattattgtattttagtttgggttatagagtaagattttatttttaaataagagagatatgataattaaataaattgtgtaattttggattaaattttaaattaaatatatgttattggtaaaataagtggtgaaatttgaataaagtggatagattagataatagtgttatattagtgttattttttgattttgaatattaataatagaatgtttttggttttgggaaatataatttgaagtgattagaggtttagggtattatatgtaaattagatatatttttttcggggagagagggagagggagagaggttgaatgatgaagtaaatgtggtaaaatgttaattttggggaaatttggatgaagaaattatagattttttttttttttatagatagggtaatattttgttatttaggttagagtgtagtggtacgattatggtttattgtagtttttatttttttgggtttagatgatttttttattttagttttttaagtagttgggattataggcgtatagtattatatttggttaatttttgtattttttttttttttaggttcgttttaagtaatttatttatttcggttttttaaagtgttgggattataggtgtgagttattgtatttggttagaaattttttaaattatttttgtaagtttggaattatgttaaaattaaaagtttaaaataataaaagataatatttttatatttttttggtgaaggtaattatgttatggttgagagggtggttgaggtttgaggatttagtttatataagttttttttatagagggtatttaagcgtttcgtagggggaaggataaagaaaatatttagagttatgatagttgtgtaaggggaaacgttagtatcgagtattgaatttttagtaaataagaaggaggcgggttgggtgtggtggtttacgtttgtaattttagtattttgggaggttaaagtgggttgattatttgaggttaagagttcgagattagtttggttaatatggggaaattttgtttttattaaaaatataaaaattagtcgagtgtggtggtatacgtttgtaattttagttatttgggaggttagaataggagaattgtttgaatttaggaggtgaaggttgtagtgagttgagattgtattattgtattttagtttgagggatagagtgagatttcgttttaaagagaaaaaaaaaagaattagtatatttgtttgttttaagaagatataattagttttgtatagtagttatatgtatttattaggatatattttaaggttttagtggatgttgaaaattatatagtattttatatgtatatatatatgtatatatatatatatatatatacgtatatgtatatatatatgtatatatgtatgtatgtatatatatatatgtatatatatatatatgtatatatatatgtatgtatatatatatatgtatatgtatgtatatacgtatatatgtatgtatatacgtatatatgtatgtatatatatatatgtatgtatatacgtatatatgtatgtatatatatatatgtatgtatatacgtatatatgtgtgtatatatatatatgtatgtatgtatgtgtgtatatatatatatatgtgtatatatacgtatatatatgtatgtgtatatatgtatgtgtatatatatatgtacggtattatgtagtatatatatatatatatgtatatatgtatatatatatgtataaatgtatatatgtgtatatatataaaaggtatatatgtatatatgtgtgtatatataaaatgtatgaatttttttttttttattgtagattttaataatttttgtatagaatttttttttattaagtggagagttagttatttatttaaaagaaatgttttttggttgggtgtggtggtttatatttgtaattttagtattttgagaggtcgaggtaggaagatttatttgaggtgaggagttggagattattttggttaacgtggtaaaaatcggtttttattaaaagtataaaaatgagttgggcgtggtgttgggtgtttgtagttttagttatttaggtggttgaggtaggagaattgtttgaatttataaggtagaggttgtagtgagttgagattatattattgtattatagtttgggtaatagagtaagattttgttttaaaaaaaaaaaaaaaagaaagaaaaagaaaaagaaaagaaatgtttttttttttattaagttttttaaatgaaaagtttttttttttatttttattttattgaaatattataatattatttttgaagaagttagtgttattattttattttgatgaaattaattaatttatttaagtatatgtatattgtatatagagaagttaacgttaaaatttttatttttatttttttagatttagtagatatatgtgtaggttttttatgagtatattgtatgatgttgaggtttgtattaatgatttagttattaaataggtagatttttaagttttgtttttttttttatttaatgtttagcgtttttatttataagtgagaatatgtggtatttggttttttttttttttttttttttttttttgagatggagttttatttttgttgtttaggttggagtataatggtattatttcggtttattgtaatttttattttttaggtttaagtaatttttttgttttagtttttcgagtagttgggattataggtatgtgttattatattcggttaattttgaatttttagtagagatagggtttttgtatgttggttaggttggtttcgaattttcgatttaaggtgatttatttgttttagttttttaaagtgttgggatgataggcgtgagttatcgtgtttggttagtatttggttttttgtttttgtgttaattcgtttaggataatggtttttagttgtatttatgttgttgtaaaggatataattttgtgattttttaaggttgtatagcgttttgtggtgtatatatattatattgtttttatttagtttatttttgatgggatttgggtggattttatgtttttattattgtgaattttgttgtaatgaatatataagtgtatgtgtttttttggtagaatgatttatttttttttggttatatatttagcgatgggattgttgggttgaatggtaattttgtttgtagttttttgaaatatttttaaattaaattgttttttatagtggttgaattaatttatatttattaatagtgtataagtgttttttttgttttataattttattagtatttgttaatttttggttttttagtaatggttattttgattggtgtgagatggtattgttgagggataatttaggaattagagagatcgaggggttgaggaggatttattattattattattatttaggtgtatcggttttagttagattaatatttaaaaagattgaggttcgaatagagagttcggttattttttaagtattttgtggggttgggggagatttgtgtagggggaagtatattatagaagtaagaaataaaggtagttatttaattgagatatgtattatattattttttattttttaagaaaaatatgttttacgatttgaggttattttgtttagtgattttgtagtcgtacggtaagagaaatagggtttttataatgtttgggaaagggagagataaggtttattagttatagatagaaaaataggtagtttatgtttaaaggattttatttttttttttttttcggggggaattgggtttttttaaatataattgagtttttgtttatatattttgtaattttttttaatttttgttttagtattttattgtgaaattttttatgtttttatacgatttttagggggttttttttgggtatgattgggtataattttttatagttagttttgggtacgatttttatattgtagaattgagaagttgatttagaaatgtattttgggttgagtagataattgttagagttgttggttagattatagatgtgttagagggattacggtttttttgtaagtttatggttagaggcggaggggagttgtgaacgttttgatgaaagtagttaacgtgaaagcgttttggtgatgggcgttggtgtttatttattattttttgtgtatttatttttttggttcgttcggtttagtttttattgtttagtattaggtcggtagaatttgagcgatgttttttatattttttgttttgttttgcgtcggtgagttttggcgtggaaggggaatgggattacggtgtgtttgggaggtaataggttttattattttcgttttttagggttgtgtttgagttagaggattagcgtttagtagcgtgagttttttttttaaagtttagggttattttttcgggtttaggttaagttttttttatttaagtacggttggggagaggggatagggtgttggttttttaggagagtttggggttagtagttgggtggagtttaaggttggggggagggggtttcgttggaattttagtttttgatttttttttagagatttttttaaaatcgtttatttgggtcgagttttattttatggttttaaaggaaaagtaagtgattatttgttgttagggaaattatggggttgttgaatattagttgtattttgaaggaagtttttttgtcgtggatagattaaaattttttgagcggattaataaagttaaattttatatttcggatatgaattttcgtatggtagggtaatatagttgtatttatcgggttggggagttttggttagagtttagtaatttgttggatttggtggtaataggtaattgttcggttttttaattggagagtgattttagtttgtattcgggatgtagtattatttatgaatttttttaagttttatttagatattgtttgtttcggtaggaggttggaaggaggggtgatttttattataatttttgtttataaggggttgtttgtagatcgtgtttttacgttttaggagtagatgtgtttttagttagtttttttatgatatagattttgagatagatatttgtatgtaggggtatgattgaggaatgtttttaaaaataatgtttgtgggttaggcgtagtggtttatattttgttttttttatttattataggtggtgggttttttttttttttatttgttttgagacggagtttcgtttttgttatttaggttggagtgtagtggtgtaatttttagttattgtaatttttattttttgggtttaagtgattttttagttttagttttttaagtagttgggattataggtatttattattacgttatattttgtatttttagtagagatggggttttattatgttggttagggtggtgtcgaatttttgattttagatgattcgttcgttttatttttttaaagtgttgggattataggtgtgagttattatatttagttaggtggtggttttttaaaaaaaaaaaaaaaaattagttttttttttttttaataatatggttgtttattattattattaagtattatatatagttatatatatatatataattgtatgtgttatataattaggtttgtttatattagtaatattaaaaatatatgagtaatattttgtgttaggaaggttatgatgttattaggtaataggaattttttagttttattataattttatgggattattattatatatgtggtatattgttggttaaaatgttattatgtagtttataatagtattttatgtttatttaaatatttttttttgtgaaatgtttatttaaattttttgtttatttttaaattgggttgtttatattttgattgattaggaaaagttatttttatattttgtgttatatatttgtgttgaaatatatatattttttgtttgtgtttttttatttgtttagggtttttggattttgtttggaggttttggtaggggaatatagttatttatttatttttttttttttaatttttttagtatttattgattatttttgggtgtttttcggagagggggatttggtagggttataggataatagtggagagaaggttagtagataaatatgtgaataaaggtttttggtttttttaggtagaggtttttgcggtttttcgtagtgtttgtgtttttgggtatttgagattagggagtggtgatgatttttaaggagtatgttgtttttaagtatttgtttaataaagtatattttgtatcgtttttaatttatttaattttgagtggatatagtatatgttttagagagtacggggttgggggtaaggttatagattaatagtattttaaggtagaagaatttgttttagtatagaataaaatggagttttttatgtttatttttttttatatagatatagtaataatttgattttttttttttttttttatattttttttttttttattcgataaaatcgttatcgttattatggtttatttttaatgagttgttgggtatattttttagacggggtggcggtcgggtagaggggttttttattttttagacggggcggtcgggtagaggcgtttttttattttttagacggggtagtggtcgggcgggggttgttttttaatttttcggacggggcggttggtcggggttttttttttttttttttgagatagtttcgttgtagtgtagtggtataattttagtttattgtaatttttgttttagttttaatttttttgttttagttttttaagtagttgagattataggtatgtgttattatattcggttaatttttgtatttttagtagagacggggttttattatgttgattaggttggttttaaatttttgatttaggaggtcgagtttttagtaagtaaagatagtgttacggcgttttagtttgggaaatagagtaagattttgtattatttttaaaaatggttttagacggtaaattttttattgtgtgtatttgattaaaataataattaaaaaaaaaaaaaaagttggttgttaggtatggtggtaggtttttgtagttttagttatttgggagggtgaggtaggagaaacgtttgaattcgggaggtagaggttgtagtgagttaagatcgtgttattgtattttagtttgggcgatagagagagattttatttttaaagaaagaaaaaaaaaaatagttggttgtttattattgagtttttggtgtggtggttttatttttttttatagaaatgtatgatatatttattttttcggtttattttggattcgaagtgatttcgggagagaaggtgattttttattgtcgtttagatattgtaataagtatgtttttattgtttaaggagggaagatttagttacgtatagcgcggatacgggaaggtttaggcggagttttttttgggttttgtgattatagtttatcgagggatatatcgatgttttggtttttataataattatgtttggtttttttttagtgagttagtgaagtttttggttataggtgaggaaatgtttaattttttatatttttcgtcgttatgttttatttggagttttgagggatttttagagagtgatggggagggtgtttaagggacgtttattttttgggtgtttggttggttatgtgaggaagaatattagaagtaggaaggaggagggagtagagaaaggaatggtaaggcgggtggattataaggttaggagttcgagattagtttggttaagacggtgaaatttcgtttttattaaaaatatagaaattagttagacgtagtggcggatatttgtagttttagttatttaggaggttgaggtaggagaatcgtttgaattcgggaggcgggggttgtagtgaatcgagattatattatcgtattgtaatttgggcgatagagtaagattttattttaaaaaaaaaaaaaaaaaaaaaaagaatggtaagatcggaggaaattaaaaatttttatttttttttttttatttttttttttaggcgatattgagaatattagttttgtatttgaagattttattttttttggtgagtaattggtttttttaagtttagacgagcgattagagttttttagtgatattaaaaacgtggtatttatttaaaatatttatcgaggttaggcgtggtggtttacgtttgtaattttagtattttgggaggtcgagatggtgtattatttgaggttaggagtttgagattagtttggttaatatggcgaaattttgtttttattaaaaatataaaatttaggttgggtattatggtttatatttgtaattttaatatttcgggaggttaaggtggttggattataaggttaggaattcgagattagtttgattaatatggtgaaattttatttttattaaaaatataaaaattagtcgggtttggtggtgttcgtttgtaattttagttatttaggaggttgaggtaggagaattgttgaatttgggatgtagaggttgtagtgagttgagatcgcgttattgtattttattttattgtacgatatagcgagattttattttatagaaaaataaaaataaaattattatatatatatatttattaagtgtatagtatatatagtgaattatattgtaatagttagttaggtagatattttgattttgtagtatttagattttagtaggaggagatatattatcggttaacgttaggatagtatataggagggaatgatgttatggaaggaaaagataaagtagaatagatttatagtgattgaaatggtagttagtaatattaaataggtttgtttagatggattttatagagaaagaaggtatttgagtaaatgcgtttagatttgagttaattatgtggttgttaggagaaaggaggttttggagagaatgaaatggtatttgtttgtgttttggggtaggaagataattggggtaatataataataattatgaggttaggagggttgaaaatgatgtttggaagatgacggtgggatgggtttggggcgtacggttaggattataggagtgaggttcggcgcggtggtttacgtttgtaattttagtattttgggaaatcgaggtaggtgggttatgaggttaggagattaagattattttggttaatacggtgaaattttgtttttattaaaaaaaaatataaaaattattcgggcgtggtggcgggcgtttgtagttttagttatataagaggttgaggtaggagaatggcgtgaattcgggagacggagtttgtagtgagttgagatcgcgttattgtattttagtttgagcgatagagtgagatttcgttttaaaaaaaaaaaaaaagaaaaagaaaaagaaaaaaaaatagtgagattttgaattttattatgtgtgtatgtgtgaggagaaagaggtaatgatgatttaatgaggaaaatgaggtttaaatagaagacgggttgggtcgggtggttttcgtatgtaattttagtattttggaaggtaggggcggttggattatttgaggttaggagtttaagattagtttggttaatatagtgaaattttatttttattaaaaatataaatatgagttgggtgtggtggcgtacgttagtaattatagttattcggggttgaagtaagaggattgtttgaattcgggaggcggaggttgtagtgagttgagattatattattgtattttagttttagaggtttgttattttagttttttgggaggtcgaagtaggtaggttatttgaggttgggagtttaagattagtttggttaatatggtaaaatttcgtttttattaaaaatatgaaaaaaattatttgggtatgtggtgtgtgtttgtagttttagttattttagaggttggaatatagtgagattttattttaaaaaaaaaaaaaatagaagatatgattggtgtaaagatatatgtttataagtgttagaatggaatttttcgttaggttcgtttatttgtggatttttttattttatttgttggatgaagtttttgggattcgtagggtgaggtgggattttgtaaagttgtagaacgttatggggtagatttaagggaaggagtgttggggtggaggaggttaaaattatttttttttttttattttttttattattagtagatatttggggtatttattttttaattatagagacgggattttagaaaggtaagtagatagttggggttataggttttgaaggaaggggttgggtatagagtagatttaggaagggaatttaaatgggaataagagggtgtttttggttaggcgtagtagtttatatttgtaattttagttttttgggaggtcgaggcgggtagattatttgaggtcgggagtttaagattagtttggttaatatggcgaaattttatttttattaaaaatataaaaaaattagttaggcgtggtggcgtgtgtttgtagttttagttatttgggaggttgagataggagaatagtttgaatttaggaagtggaggttgtagtgagtcgagatcgtgttattgtattttagtttgggcgataagattgaggttttgttttaaaaaaaaaaaaaaaaaaaaaaaaaaaaaaaaaaaaaaagagggtgtttttatatttttgttagcgattattttgtttttttgtttatagattatgttttttgggattatattgtttagaatttttttcggatgggtttggtttttttagttttggtggttttagtgtggtttttggttgaagattggtttagtaggaagaggattagagagcgagttagtagagtttttatttgggaaggtaggagaaggttgaatatatagattttttgaagaatgattatgagatatagtggttatgggtggatttgaaagttggtgttgagtttgggcggcgtgagttttgtgttggatttacggaggagggagttattgtagggaaagagggatattggtattttatttgttagagtatttcggacgatgtagagggtgggagaattatatgttaaatttttttttttttttttttgagatagagtttttttttgttgtttaggttggagtgtaatggcgcgattttggtttattgtaatttttagttttttatttttcgggtttaagtgatttttttgttttagttttttgagtagttgggattataggtatgtgttattattttagttaattttgtatttttagtggagacggggtttttttttgttggttggtttcgaatttttgattttaagtgattttttcgttttggttttttaaagggttgggattataggtataagtcgttgcgtttagttattgaattttttttgtagataaattttatggttttttttaggttttaattatttttgtattatttattgtaaattatatttttaattattttggttttttttgaaaagatttttttttttttaataggatggttatggaaatattttttttttattttggttttttttttttttttttttttgtaggaagttatttaaaatagttaataattaatatagaataggtttgtattaaatggtttaggaggtattgtggtaataattagttgtagagaagtagttttataagtgaattttgttaggtacggtggtttatatttgtaattttaatattttgggaggttgaggcgggtagattatttgaggttaggagttcgagattagtttggttaatatgatgaaattttatttttattaaaaatataaaaattcggttaggtacggtggtttatgtttgtaattttagtattttgggaggttaaggtgggaggattatttgaggttaggagttcgagagtagtttggttaatatggtgaaattatatttttattaaaaatataaaaattagttaggtatggtggcgtgtgtttgtaattttagttatttaggaggttgaggtaggagaatagtttgaattcgggaggcggaggttgtagggagttaagatcgtattattgtattttagtttacgtgatagagtaagattttgttttaaaaaaaaaaagaaaaaaaaaaaataagtgatttttggttgtattttaattatattttaattttttttaattatagaattattttatttttttttttttttttttttttttttttttttttgtttgttttgttgggatagaattttattttttttttttttaatgtaagttttagggtatatgtgtataacgtgtaggttagttatatatgtatatatgtgttatgttggtgtgttgtatttattaattcgttatttaatattaggtatattttttaatgttattttttttttcgagttttatttttgttatttaggttggaatgtagtggtgtaattttggtttattgttatttttatttttagggtttaaatgatttttttgttttagttttttgaatagttgggattataggtatgtattattacgttcggttaatttttgtatttttagtagaaatggggttttataatgttggttagattggttttgaatttttgattttaggtgatttattagtttcggttttttaaagtgttggaattataggtgtgagttatcgtattcggttattatttttgtttttttatttatattttgttttgttttttagggttttgtagagatattattttttttaagagtttttataatttcgattttataaagatagtatttttttttttttttttgagatagttttattttgtagtttaagttggcgtgtagtggtataattttagtttattgtaattttcgtttttggggtttaagcgattttttttttttagttttttaagtagttgggattagaggcgcgcgttattatattcggttaattttttttgtatttttagtagaggtagggttttattatgttgttttgggtggttttaaatttttgagtttaggtgattttttcgttttggttttttaaagtgttaggattataggcgtgagttattgcgtttagttaagataatattttttttattttaaagtatttgttaattttttgtaatagtatttgaattttgattcggtatgtatgtttatttttttgtttttatcgtgaattcgtgtgaattgatttatgttagatttagtggttgtatttatagttttcgtaattataacggggttttcgggaaatatatattaaatgagtgaatgtatatacggggttgtggtatagtttgtaatttgagattttttattaggggttttgaaatgttgtttggatattattatcgtttttttttttgagaatttttatttattaatttatttatatatttatcgtatgggtttttacgtttttttattattttggtgttttatgtcggttaaatttattttttaaatttgatttttttattaaatagtagtttggttaatacggtaaaattttatttttattaaaaaatataaaatattagttaggcgtagtggtttgtattcgtaattttagttattcgggaggttgaggtagtagaattatttgaattcgggaggtagaggttgtggtaagtcgagattgtattattgtattttagtttggtaatagagcgagatttttttttaaaataaataaattgttgattcgcgtattttttttttattttaatttattttttatatgtaggtatttgtaattttagttatttagaaggttgaggtaggagaatcgtttgaatttgggaggcggaggttgcggtgagttaaaatcgtgttattgtattttagtttgggcgatagagcgagattttattttaaaaaaaaaaaaaaaaaaattatataggtttagtttttttagtatttgttttattggtttagtaaaagttaggaaatataattttgtggtaatttgaatgttattgaattgtattttgtttattttattgtaaatattagtgaatagtgaataaatggttgtatatttttaataagaaaaaaaaaaaaaaagatttaaagtatagcgagttgatgtcgattttatttcgtagaggttcgtttgtttttttttttttaagagtgtaattttatgtttaataaatttatgtcgttttgttatgtgtgtgtattatatttaattttttgttcgaaatattaagggtttggaattttatagttttggttggtaacggggagtaggggtaaagatatttaaaagttgtttgtgttaattataatcgttattttatatattagatttttagaattaatttattttataattgaatattgtgttttttttttttttttttttttgagacgaagttttgttttgttatttaggttggagtgtagtggcgcgattttgattttgtaattttcgtttttcgggtttaagcgatttttttgttttagtttttcgagtagttgggattataagtgcgtgttattacgttcggttaatttttgtatttttagtagagacggggtttttttatgttggttttaaatttttggttttaggtgatttattcgttttggttttttaaagtgttgggattatagacgtgagttattatatttagttatttgtgttttttgattaatattttttttttttattatttttagtttttgataatttttatttatttttatttttaggagattaattgttttatttttttttttttttttttttttttgagtttcgttttgtatatttaggttggagtgtagtgttgtaatttcggattattgtaattttcgtttttcgggtttaagcgatttttttgttttagtttttagagtcgttgggattattgagttatcgcgtttagttagaagatttacgttttttaagatataatttatattggtggtttttgttttgattttttatttgtgttttttattcgttagaaattggtttttttttttatattttttttgaagttgtttgtgtgattaatattaatgagttttttttttggaatatgtagtgattttttttagttttttttattattgtttttttatagttgtatttgatacgttgattatttttttttcgaaggatttatttttttggttttttcggatattttttgttattcgttttttgacggttatagtattaataggtttgtaggtatttttattattagagttaattttagttattcgggaggttgaggtaggagaatcgtttaaattcgggaggtagaggttgtagtgagtcgagattgcgttattgtattttagtttgagtgatagattgtgattttttaaaaaaaaataaaaataaaaataaaaaaattatagttttgttttgtcgtttaggatggaatgtagtggtgttattttggtttattgtaatttttgtttgttggggtttagcgatttttttgttttagttttttaaggagttgggattataggtatgtgtcgttacgtttggttaatttttgtatttttagtggagatgggggttttattatgttagttaggttggttttgaattttcgattttatgtgattcgtttattttggttttttaaagtgcgaggattataggttttcgtatttagtttaggattttgtatttttttagtttagtagttttttgttgggtgattttgttttttattttaggggatatttggtaatgtttatggtaatttttaattgttatgatttggggaggggttttattggtatttggtaggtagggtttaggggtgttgtttagttttttataatgtttagggtagttttagatggtagtagtattaaggttgagaaatattggtttatgtagaaagtaattattttatattttttagtgtagggataaaggtagggttacgagtttacggaaattttttagttttagtttacgtaagacgtggttattttttttttttattgtttttatttatttattttttttgagatagagttttgttttgtcgtttaggttggattgtagtggcgcgatttttgtttattgtaagtttcgtttttcgggattatattatttttttgggattataggcgttcgttatttagttcggttaattttttgtatttttagtagagacggggttttattatgttagttaggatggtttcgatttgatttcgtgattttttcgtttcggttttttaaagtgttgggattataggtgtaagttatcgtattcggttttatttatttattttttgagatagagtttgagttttttattttatttatttagagattaagtttcgttttgttatttaggttggagtgtagtgtcgtggttttagtttattgtaataattttcgtttttcgggtttaagcgatttttttattttggttttttaaagtgttggtattatagatatttattattatgtttggttaattttttgtatttttagtaagtaaagatagggttttattattttggttaggatggtttcgaatttttggttttaagtgatcggttcgtttgggttttttaaagtgatgagattataggcgtgagcgattatattggtttaatgtgtagttttttatttgtggttttttttttgtttttttttttttgagattttgaagtttattatattattttgtttttgtgtattaatagtttagtttttattgagaatatatagagttaggtacggtggcggtggtttacgtttgtaattttattattttgggggtgttgaggtaggtgtatcgtttgaggttaggagtttaagattagtttggttaatatggtgaaattttatttttattaaaaatagaaaaatatatagttgggtgtggtggtacgtgtttataattttagttattagggaggttgaggttggagaatcgtttgaatttaggaggcggaggttgcggtgagttaagattatattattgtattttagtttgggtaataagagtaaaattgttttaaaaaaaaaaaaaaaaagtgagaatatatggattttatttttgttagaataatggtttttagttttatttaaattgttggaaatgatattattttattttttttaatggttgaatagtattttatggtatatagatattacgttttttttatttattgtagggattagttttatagggtcggtgggtttttttttgtgtgcggcgacgagagagtgtagaaataaagatataagataaagagataagagaaaaggtagttgggttcgggggattattattattaatgcgcggagatcggtagtggtttcgaatgtttggttgcgttgttatttattggatataaggtagaaggggtagggtaaagagtgtgagttatttttaatgataggtaaggttacgtgggttacgtgtttattggatagggggtttttttttgtttggtagtcgaggtagagagggagaggagatagagagaaagatagtttacgttattatttttgtatattagggattattagtattttttttaatttattattgttatttagaaggtagagttaggtgtataggatggaatatgaaggcggattaggagcgtgattatcgaagtatagtattatagggagacggttaggttttcggataattgcgggcgagtttgattgatgttaggttttttataagaggtggaggagtagagttttttttaaattttttcggggaaagggagatttttttttttattcgttgtttttttttcggtttgttaagtagcgggtgttgttaattgatattttttgttatcgttggattatgattcgtttggtgacgggtgtttttttagacgttggcgttatcgttagattaaggagttttttggtggttttgttcgggtataatagaaggttcgtatttttgttttttggttatattttattatgtttttttagtttttatttttgtatggtttggttttttttaggttatgattatagagtgaggattattataatattggaataaaaagtaattgttatcggttaatgattaatgatatttatatataattatatttaagatttatatttggtataataatttttgttttatattttattatattggaatagttcgtgttttttgttttttgtttcggtgtttgggtgttttgtcgtttataatttatttattatttaatgggtatttcggttggttttatatttttgtaattgtgaatggttgagttagttatttttaattgggggtgattttgtttttatgggggtatttggttatatttcgagaggttttttggttgttacgagttgtagtgggggtaggtttaggtttatttaagtttaggggtgttgttatatattacgtgatatataggatagtttttgttacggattgaattggttttattaaacgttatgtataagttttattttagatgtgattttatttggatatagggttttttagaggtaattaaggttggttaggcgtcgtaattatagtattttaggagttttgtgtttattattggtaagtgggtaagagtttagtgtggtagtttacgcgtgtaattttagtattttgggaagcgaaggtaaggggataattggaggttagtagtttaagataagtttggttaatatagtaagattttatttttataaaatattttaaaattagttaagtatgtttggtatgtatttgtaattttagtttaggaggtttaggtgggaggattttttgagtttaaggttgtagtgagttaagatcgtattattgtattttaattcggttgtgggtaatatagtattattattattttggttgggtacggtggtttacgtttgttatgttagtattttgggaggtcgaggcgggtggtttatttgaggttaggagtttgagattagtttggttaatatggtgaaattacgttattgtattttagtttaggtaattaagtgagattttgttcgttttattattttattaaaaaaaagattattattttaaataaaattaaaatttttaagtagataaaatatttaggggaaaaaaattttaattaaatatgtagtagagttcgatttagatgtttttatttttagtttttatttattatttttgtgtttttatttttagtaaattttatacgggaattttatgtgtatgtagaattttaaatgttgatttagttttattttttattatttgattattttttttatttacgttgtttttattattttttttatcggtgtgagttgtatttcgttaaatattgttattatttatagtttgtattattattagttgattgtagttttaaatattatagtgatttcgagtatttgagaagatttattttgataagggtttacgaaagatagtaatgtttaatagtaagataaatgagggtttttatgggattatttagtgttgaagttatttaatttttaggtttgggttagtaaaaagaattttgttaggttaggtatagtggtttacgtttgttattttagtattttgggaggttaaggcgggtagattatttgaggttaggagtttaagattagtttggttaatatggtgaaatttcgtttttattaaaaatataaaaattagttaggtatggtgacgtatatttttagttttagttatttcggaggttgggatagaagatttatttgaatttaggaggtagaggttgtagtgagttaagatcgtattattgtattttagtttgggcgatagaggtaagattttattttaaaaaaaaaaaaaaaaaaaaaaagaaaagaaaattttgttatataagtttttaatttaaagtattagttatatgttcgtgtttttgtgtttgggattatgataattttttttatattaatgtttttattttttttttttcgagataagagttttgtttttattgtttaggttggagtgtagtggtataattttagtttatcgtaaatttcgtttttcgggtttaagcgatttttttgttttagtttttcgagtagttgggattataggtatatattattttattcggttaattttgtatttttagtagagacggggtttttttatgttgaggttggtttcgaatttttgattttaggtgattcgttcgtttcggttttttaaagtgttgggattataggtgtgagttatagcgtttggttgtttttattaaaatagttttattatttatcgtaagcgtggagagttaagtgaggagaggggttagttttttttggtagcgtttggaagttagtgttaatattatggtgataattttttatttttaaggaaaattgcggagtgatttttatgtattttttatgaatgattaaatatagggtgtggaaaagttgtgtttgttatggtaatgggaagtcgagagaaacggggaggcgagagagatagagatatatatagagatttttagagatagttatatagatttatatagaaatagatagataggttgggttcggtggtttacgtttgtaattttattattttgggaggttgaggcgggtagattatttgaggttaggagttcgagaatagtttggttaatattgtgaaatttcgtttttagtaagaatataaaaaattagttaggtatggtggtatagggttgtaatttcggttattcggaaggttgaggtaggagaattatttgaatttgggaggcgcggttgtagtgagttgagattacgttattgtattttagtatgggcgataagagtgaaatttcgttttaaaaaaaaaaataaaaaaaaaaaacgaaagaatagagagatatatataaagatagagatagaaacgtttagcgatagagatatatatagagaaatatagatagatatagagatatatatatagaaatagatatagagatagagagataaaaagatagatatagagaaataaagagagatatatagagatagagagagagagagatatatatatatatatatagagagtaggaggcggttcgtgggagtcgagtagaattagcgtgaggtagggttattttttgaattaaaggtaatagtgattgtaagtttgtgttttgtgagtaataggatagattagaatagggttggttgtttatggtttacgagttgtttttgggaagttttcgtaggtgttagttaggttttgcgttgtttttatgtttaaaggtatagttgagagttgatgagagatcgcggggtttatagtgttaagtatatgaattatttggttcgtttgttaatgcgtgggttgattatataagttatgattatataagttataaagatatattgattatatagatgtatttggtagatagtagattatatggcgtttgagttagggaagaaaagaaatagaagaattaatcgaattatttttgaattttttagtaatatttttttttagataaagtatagagtattatgtttattgtaggtttgtttttgagtatgttaataaacgtagttgtaacgagagtgttttaattttattatttttgtgagaaagtatatagcgttatgtgaagggggtgcgtgattcgtgtagaattttttaaaaatagtgagaaaattagtgttaaattttatttttcgatagattttagtgttaatatgtgattttttgatttgtatttataagatattttagagattcgaatttcgttttttgtgtaattcgtagagcgattttaggttgtttagtaaaaaaagttatagtacggaggtgtcgttgtttcggaagtattgtaattaatagttagtttgggattttttttttttattttttttaatagttttttgatttttaaattagttttataggtttttaatttggagggattagagaatataaatgtttttagaaatttatttttaattatttaggatgtttgaatatttgtttttaaatatttaaagtaggaaacgtttttgggattttttgggggatagggttttgttttgttgtttaggttggggtatagtggtgttattttggttttttgtaatttttagtttttaagtttaagtaatttttatgttttaggtttttgagtaattgtgattataggtgtgtattattacgtttggttaagttttgtatttatagtagagatggggtttcgatatgttagttaggttggtttcgaatttttggttttaagtgatttatttatttcggttttttaaagttatgggattatagatgtgagttatagtatttagttagaaaagttttttaaaaagaaatttagatttatataatggggatttttataagtttaagaaaaaaaagattatggttaggtacggtgtttcgtatttgtagttttagtattttgggaggttaaggtaggtagattgtttgagtttcgtagtttaaggttagtttgggtaatacggtgaaattttgtttttattaaaaatagaaaaagttagttaggaatggtggtgtacgtttatagttttagttattcgggaggcggaggtaagaggattatttgagtttaggaggcggaggttgtaacgagttagagattgttttattgtattttagtttggtaatagagtaaaatatgtttttaaaaaataaatttaaaaaatagataattaggttggtgtacggtgatttacgtttataattttagtattttgggaggtcgaggcgggtagattatttgaggttaggaattcgagattagtttggttaatatagtgaaatttcgtttttattaaaaatataaaaattagttgggtatggtggtagataattgtaatattagttatttaggaggttgagataggagaatcgttttgaatttgggaggtagatgttgtagtgagttaatatcgtattattgtattgtagttcgggtgatagagcgagattttgtttttaaataaataaataaaaaatagtggtaaattaaatttttagtagaattaagagaatgttagagtgaattttagggttaatgatagtaaatttggttttaacgtggttgtagtatgtaagtttgtgtatgtgaatatgaggggtggtgattgtggagatattggtttgttatgttgtttaggttggttttaaatttttggttttaaataatttttttattttggttttttaaaggaggaattgaggaatgagaaaagaaatacgttttaaatatatgatataagagattatagggggttagagatttgttattaatagtttttggtggtattatagatttcggttttattaataagagaagtatgatattatttagtttaagttttatgatatatttttaaaattttaatttatttatgttagaggttataattatttgaattgtagacgtgtgaaaaatcgtattttgagtaggatataaataatttttatatgtttagcgttttaataatgtaatattgggtattatgaagtagtttatatgcgtattatttttataattaaaataatttttgaataagataagtgggttgtgtatagtggtttacgtttgtaattcgggtattttgtgaggttaagataggaggatcgtttgaagttaggagtttgagaatttcggtaatacggttatatagtgtagtagagtaaaacgttgttttagaaaagaaaagataaaggtaagaagaaattaaaggtagattacgttaaaataagttattgaggtcgggcgcggtggtttacgtttgtaattttagtattttgggaggtcgaggtgggtagattatttgaggttaggaattcgagattagtttggttaatatagtgaaattttatttttattaaaaatataaaaaattagtcgggcgtggtggcgggcgtttgtagttttagttgttcgggaggttgaggtaggagaatggcgtgaattcgggaggtggagtttgtagtgagtcgagatcgtatcgttttattttagtttgggcgatagagattggagtttttgttttaaaaaaaagatagatttaaaaaaaaagatagatttcgttttaaaaaaaagatttcgt

SEQ ID NO: 32 - DNA, 30068 bp, Artificial Sequence
  chemically treated genomic DNA (Homo sapiens)
acggagttttttttttgagacggagtttgtttttttttttgaatttgttttttttttgagatagagattttagtttttgtcgtttaggttggagtgaagcggtgcgatttcggtttattgtaagttttatttttcgggtttacgttatttttttgttttagtttttcgagtagttgggattataggcgttcgttattacgttcggttaattttttgtatttttagtagagatggggttttattatgttggttaggttggtttcgaatttttgattttaggtgatttgtttatttcggttttttaaagtgttgggattataggcgtgagttatcgcgttcggttttagtgatttattttaacgtaatttatttttagtttttttttgtttttgtttttttttttttgagataacgttttgttttgttgtattgtgtggtcgtgttgtcgaggtttttaaatttttggttttaaacgatttttttgttttggttttataaagtattcggattgtaggcgtgagttattgtgtatagtttatttgttttatttaagagttattttagttgtagagatgatacgtatgtaaattgttttatgatgtttagtgttgtattattggaacgttaagtatgtgggagttatttatattttgtttaaggtacgattttttatacgtttgtagtttaaataattgtaatttttggtataaatgggttaaggttttaggggtatattatgaaatttgagttaaatagtgttatgttttttttgttggtgggatcgaggtttgtaatgttattaaggattattggtgataaatttttagttttttgtggttttttatgttatatgtttggggcgtatttttttttttattttttagttttttttttgggaggttaaggtgggaggattgtttgaggttaggagtttgagattagtttgggtaatatagtaagttagtgtttttataattattattttttatgtttatatatataggtttgtatgttgtagttacgttagagttaagtttgttattattaattttggggtttattttggtatttttttagttttattgaaggtttgatttgttattattttttatttatttatttggaggtagagtttcgttttgttattcgggttgtagtatagtggtgcggtattggtttattgtaatatttgttttttaggtttaaagcgatttttttgttttagttttttgagtagttggtattatagttgtttgttattatgtttagttaatttttgtatttttagtagagacggggttttattatgttggttaggttggtttcgaatttttgattttaggtgatttgttcgtttcggttttttaaagtgttggaattataggcgtgagttatcgtgtattagtttgattatttattttttaaatttattttttaaaggtatgttttattttgttattaggttggagtgtagtagggtaatttttagttcgttgtaattttcgttttttgggtttaagtgatttttttgttttcgtttttcgagtagttgggattataggcgtgtattattatttttggttaattttttttatttttggtagagatagggttttatcgtgttgtttaggttggttttgaattgcggagtttaagtaatttgtttgttttggttttttaaagtgttgggattataggtgcgagatatcgtgtttggttataatttttttttttttagatttataaggatttttattgtgtgggtttaaatttttttttagaaaatttttttgattgggtgttgtggtttatatttgtaattttatggttttgggaggtcgaggtggatggattatttgaggttagaagttcgagattagtttggttaatatgtcgaaattttatttttattgtaaatataaaatttagttaagcgtggtggtgtatatttgtaattatagttatttaggagtttgaggtatgagaattgtttgaatttgggagttggaggttgtagagagttaagatggtattattgtattttagtttgggtaatagagtaagattttgttttttagaaaattttaaaaacgttttttgttttgagtgtttgaaaatagatatttaggtattttgggtagttgagaatgaatttttgggaatatttgtgttttttgatttttttaggttgaagatttatgaaattaatttggaaattaagaagttgttggaggaagtgaaagaaaagaattttaagttgattattgattgtaatgttttcggggtaacggtattttcgtgttgtgattttttttgttgagtagtttgggatcgttttacgaattatataggaagcgggattcgggtttttaagatgttttatgaatgtaggttagagggttatatgttaatattagagtttgtcgagaggtaggatttgatattggtttttttattatttttgggagattttgtacgagttacgtattttttttatatgacgttatgtatttttttatagggataataaagttagagtattttcgttgtagttgcgtttattgatatgtttaggagtaaatttgtaataaatatggtattttgtgttttgtttaggaggaagtattgttaagaagtttagggatgattcggttgatttttttatttttttttttttttaatttaggcgttatgtggtttattatttgttaggtgtatttatgtgattagtgtgtttttgtgatttatgtgattataatttatgtgattaatttacgtattgataaacgggttagatagtttatatgtttggtattgtgggtttcgcggttttttattagtttttagttgtgtttttggatatggaagtagcgtagggtttggttggtatttgcggaggttttttagaaatagttcgtgggttatgggtagttagttttgttttaatttattttgttatttataaagtataagtttatagttattgttgtttttaatttagaagatggttttgttttacgttggttttgttcggtttttacgggtcgttttttattttttgtgtgtgtgtgtatgtgtttttttttttttttgtttttgtgtgtttttttttgtttttttgtgtttgtttttttgtttttttgtttttgtgtttgtttttgtgtgtgtgtttttgtgtttgtttgtgtttttttgtgtgtgtttttgtcgttgggcgtttttatttttgtttttgtatgtgtttttttgttttttcgttttttttttttgtttttttttttgagacggagttttatttttgtcgtttatgttggagtgtaatggcgtgattttagtttattgtaatcgcgttttttaggtttaagtgatttttttgttttagtttttcgagtagtcggaattatagttttgtgttattatgtttggttaattttttgtatttttattagagacggggttttataatgttggttaggttgttttcggatttttgattttaggtgatttattcgttttagttttttagagtggtgggattataggcgtgagttatcgagtttagtttgtttgtttgtttttgtgtgagtttgtgtggttgtttttgggagtttttgtgtatgtttttgtttttttcgttttttcgtttttttcggttttttattgttatggtaaatatagtttttttatattttgtatttggttatttatagaaaatgtatagaagttatttcgtaattttttttaagaatgaaaagttgttattatgatgttagtattggtttttaggcgttgttaaaagggattgatttttttttttatttggttttttacgtttgcggtaggtgatgagattattttaataagagtagttaggcgttgtggtttatatttgtaattttagtattttgggaggtcgaggcgggcggattatttgaggttaggagttcgagattagttttaatatggagaaatttcgtttttattaaaaatataaaattagtcgggtggggtggtgtatgtttgtaattttagttattcgggaggttgaggtaggagaatcgtttgaattcgggaggcggagtttgcggtgagttgagattgtgttattgtattttagtttgggtaataagagtaaaatttttgtttcgaaaaaaaaaaaataagagtattgatatggggaaagttgttatggttttaggtataaaaatacgggtatatggttaatgttttaggttgaaagtttgtatgataaagtttttttttttttttttttttttttttttttttgagatggagttttgtttttgtcgtttaggttggagtgtagtggtgcgattttggtttattataatttttgttttttgggtttaagtgagttttttgttttagttttcggagtagttgagattagaggtgtgcgttattatgtttggttaatttttgtatttttagtaaagacgaggttttattatgttagttaggttggttttgaatttttgattttaggtgatttgttcgttttggttttttaaagtgttgggatgataggcgtgagttattgtgtttggtttgataaagttttttttattaatttaaatttggaggttgagtggttttagtattgaatgattttatgaaggtttttatttattttgttgttgagtattgttgtttttcgtgagtttttgttaagataagtttttttaaatgttcgagattattgtggtgtttaaggttatagttagttggtagtaatgtaggttgtgggtggtaatagtgtttagcgggatatagtttatatcgatgggaagggtggtagagatagcgtgaataaaggaagtggttaggtgatgagaggtagggttgagttaatatttagggttttatatgtatatgaagttttcgtgtagaatttgttaaaaataaagatataaagatagtaggtagaggttgggagtgaaaatatttgggtcggattttgttgtatatttaattgaagttttttttttttaaatattttatttatttaaaaattttgattttgtttaagatagtagttttttttttggtggggtggtggggcggatagagttttatttggttgtttaggttggagtgtagtggcgtgattttattatgttggttaggttagttttaaatttttgattttaggtgagttattcgtttcggttttttaaagtgttggtatgataggcgtgagttatcgtgtttagttaagatggtggtggtgttgtgttgtttatagtcgggttggagtgtaatggtgcgattttagtttattgtagttttaaatttaaggaatttttttatttgagttttttgagttgggattataggtgtatgttaaatatgtttggttaattttaaaatattttatagagatggagttttgttgtattgattaggtttgttttgaattgttggtttttagttatttttttgttttcgttttttaaagtgttgggattatacgcgtgagttgttatattgggtttttatttatttattagtaataaatatagaatttttaaagtgttgtgattacggcgtttgattagttttaattatttttgaaaagttttgtgtttaaatagagttatatttggggtagggtttgtatatgacgtttggtgggattaatttagttcgtagtaaggattgttttgtgtattacgtgatgtatagtagtatttttggatttggatgagtttgagtttgtttttattgtaattcgtgataattaaaaaatttttcgggatgtggttagatatttttatggggataaaattatttttagttaagaatggttggtttagttatttataattgtaaagatgtggaattaatcgaagtgtttattgaataatgagtggattgtgggcggtaaggtatttaggtatcgaggtaagagatagaggatacgagttgttttagtataataaaatataaaataagaattgttatattagatatagattttagatatgattatatatgagtattattaattattagtcggtagtaattattttttattttaatattataataatttttattttataattatagtttaggaaaaattaggttatatagagataggagttgaggggatatagtgaggtgtgattagaagataagagtgcgagttttttgttatgttcggatagggttattagagggttttttggtttagcggtgacgttagcgtttgggaagatattcgttattaagcggattatggtttagcggtagtaaaaggtgttaattaataatattcgttatttagtagatcgggaaaggggtagcgggtgggggggggggttttttttttttcgggggagtttagagaagattttgtttttttattttttgtggagggtttgatattagttaggttcgttcgtagttattcggaggtttaatcgtttttttgtgatgttgtgtttcggtggttacgtttttagttcgtttttatgttttattttgtatatttggttttgttttttagatagtagtagtaaattagggaaagtattaatagtttttgatatgtagaaataatggcgtaagttgtttttttttttgttttttttttttttttgtttcggttgttaggtagggaagggttttttgtttagtggatacgtgatttacgtgattttatttattattggaggtgatttatattttttattttgttttttttgttttgtatttaataaataatagcgtagttagatattcggggttattatcggttttcgcgtattggtggtagtggtttttcgggtttagttgtttttttttttgtttttttgttttgtgtttttatttttatattttttcgtcgtcgtatatagggagagatttatcgattttgtggggttggtttttatagtggataaagaaaacgtggtgtttatgtattatggaatattatttagttattagaaggaatgaaataatgttatttttagtaatttggatggagttggaggttattattttaataggagtagaatttatatgtttttattttttttttttttttttaagatagttttgtttttgttgtttaggttagagtgtaatggtgtgattttggtttatcgtaattttcgttttttgggtttaagcgattttttaattttagtttttttagtagttgggattataggtacgtgttattatatttagttatgtatttttttatttttagtagagatggggttttattatgttggttagattggttttgaatttttggttttaggcgatatatttgttttagtatttttaaagtgatgggattataggcgtgagttatcgttatcgtgtttggttttgtatgtttttagtgggagttaagttgttggtatataaaggtagagtgatgtaatgggttttagagttttagaagggggagggtagaagggaggttatagataaaaaattatatattaggttagtgtggtcgtttacgtttgtaattttattattttgggagatttaggcgggtcgattatttgaggttaggagttcgagattattttgattaagatggtgaaattttgtttttatttattaaaagtataaaaaattagttaggtatggtagtgggtgtttgtaatgttagtattttgggaggttaaggtgggagaatcgtttgaattcgggaggcggaggttgttgtagtgagttgaggttacgatattgtattttagtttgggtaatagagcgagatttggtttttaaataaataaaataaagggtttagattttattttaaaaaataaatgaataaggtcgggtgcggtggtttatatttgtaattttagtattttgagaggtcgaggcgggaggattacgaggttagatcgagattattttggttaatatggtgaaatttcgtttttattaaaaatataaaaaattagtcgggttaggtggcgggcgtttgtagttttaggagaatggtgtgatttcgggaggcggagtttgtagtgagtagagatcgcgttattgtagtttagtttgggcgatagagtaagattttgttttaagaaaaataaatgaataaaaataataagaaagaaaaatagttacgttttacgtaggttgagattggagagttttcgtggattcgtaattttgtttttgtttttgtattgaagggtgtaaggtggttgttttttgtatgagttagtgttttttagttttggtgttgttgttatttggggttgttttgggtattgtaggaagttgagtagtatttttggattttatttattagatgttagtagaatttttttttaagttatgataattaaaaattattatgggtattgttaaatgttttttggagtggagagtaaaattatttagtagagaattgttaggttagagaggtgtaggattttaggttgggtgcgggggtttgtaattttcgtattttgggaggttaaggtgggcggattatatgaggtcgggagtttaagattaatttggttaatatggtaaaatttttatttttattaaaaatataaaaattagttaggcgtggcggtatatgtttgtagttttagttttttggggggttgaggtaggagaatcgttagattttagtaggtagaggttgtagtgagttaagatggtattattgtattttattttgggcgatagagtaagattgtagtttttttgtttttgtttttgtttttttttgaggagttatagtttgttatttaggttggagtgtagtggcgtaatttcgatttattgtaatttttgtttttcgggtttgaacgatttttttgttttagtttttcgagtagttgggattggttttggtggtggaggtgtttgtaaatttgttggtattgtaatcgttagaaaacgagtagtaagaagtgttcgagaaagttagagaagtgagtttttcgaggaggaagtggttaacgtgttaaatataattgtgggggagtaataatgagaagggttgaaaagggttattgtatgttttaggaaggaagtttattagtgttggttatatagatagttttagaggaagtgtggggagagaagttagtttttagcgggtggggagtataggtgagaagttagaataaaggttattagtgtgggttatgttttagggagcgtgggttttttggttgggcgcggtggtttagtaattttagcgattttggaggttgaggtaggagaatcgtttgaattcggaaagcggaggttgtagtgattcgagattgtagtattgtattttagtttgggtgtgtagagcgagatttaaaaaaaaaaaaaaaaaaaaaaaaatagaatagttgattttttagaagtgagagtaggtggaggttattaggggttgggggtggtaggagaggaagatgttggttaaaaagtataagtagttgggtgtggtggtttacgtttgtaattttagtattttgggaggttaaggcgggtggattatttgagattaggagtttgagattaatatggagaaatttcgtttttattaaaaatataaaaattagtcgggcgtggtggtacgtatttgtagttttagttattcgggaggttgaggtaggagaatcgtttgaattcgggaggcggaggttgtagagttaagatcgcgttattgtattttagtttgggtgatagagtaggatttcgttttaaaaaaaaaaaaaaaaaaaaagtataatatttagttataagatgagttagttttgggggtttgatatatgggatggcgattatggttaatataagtagtttttaaatgtttttatttttgtttttcgttattagttaaagttgtgaagttttaggtttttggtgtttcgaataaagaattgggtgtgatatatatatatagtaaagcggtataagtttattaagtataggattatatttttggagaggggagagtaggcggatttttgcgaaatgagatcggtattagttcgttgtattttgggttttttttttttttttttttattaggaatatataattatttatttattgtttattagtatttataataaagtgaataaaatatagtttaataatatttagattattataaagttgtgttttttggtttttattgaattagtaaagtagatattgaaaagattgagtttatgtggtttttttttttttttttttgagatggagtttcgttttgtcgtttaggttggagtgtagtggtacgattttggtttatcgtaattttcgttttttaggtttaagcgatttttttgttttagttttttgagtagttaggattataggtgtttatatgtaaggaatgagttggggtaaagaaaaaatacgcgagttagtagtttatttattttgagagggagtttcgttttgttattaggttggagtgtagtggtgtaatttcggtttattataatttttgtttttcgggtttaagtgattttgttgttttagtttttcgagtagttgagattacgggtgtaagttattgcgtttggttaatattttgtattttttagtagagatggggttttatcgtgttggttaggttgttatttaatggaaaaattagatttagagaataaatttgatcggtatgaggtattagaataatgggagggcgtgaggatttatgcgatgagtatataaatgggttgataagtagaagtttttagggaggaaagcgatggtggtgtttagatagtattttaagatttttagtgagaagttttaagttgtaggttgtgttatagtttcgtatatatatttatttatttgatatatatttttcgagaatttcgttatagttgcgggagttgtgaatgtagttattaaatttgatatagattaatttatacgagtttacggtagaggtaggaaaatggatatgtatgtcgaattagggtttaagtgttgttatagggaattaataggtgttttgggatgaggaaagtgttgttttggttgggcgtagtggtttacgtttgtaattttagtattttgagaggttaaggcggggggattatttgaatttaggagtttgagattatttagggtaatatgatgaaattttatttttattaaagatgtaaaaaaaattaatcgggtgtggtggcgcgcgtttttagttttagttatttgggaggttgaggaaggagaatcgtttgagttttagaggcgaaggttgtagtgagttgagattgtgttattgtacgttagtttgggttatagagtgagattgttttaaaaaaaaaaaaaaaagtgttatttttgtgaagtcggagttgtggaaatttttggaggaaatgatatttttgtagagttttgaagaataaggtaaggtgtggataaagaagtaaagatggtggtcgggtacggtgatttatatttgtaattttagtattttgggaggtcgaggttggtggattatttgaggttaggagtttaagattagtttggttaatattgtgaaattttatttttattaaaaatataaaaattagtcgggcgtggtggtgtatgtttataattttagttatttaggaggttgaggtaggagaattatttgaattttggaggtggaggtggtagtgagttaagattgtattattgtattttagtttgggtgataaaagtgaaattcgggggaagggatagtattaggagatatatttaatgttaaatgacgagttagtgggtgtagtatattaatatggtatatgtatatatatgtaattaatttgtacgttgtgtatatgtattttaaaatttatattaaaaaaaaaaaaagtgaaattttgttttaataaaataaataaaaaaaaagaaaaaaaaaaaaaaggaagagaagatggaataattttgtggttagaaggaattggggtatggttgggatgtagttaggagttatttattttttttttttttttttttttttgagatagaattttgttttgttacgtaggttggagtgtagtggtgcgattttggttttttgtagttttcgtttttcgggtttaagttatttttttgttttagttttttgagtagttgggattataagtatacgttattatatttggttaatttttatatttttagtagagatgtggttttattatgttggttaggttgttttcgaatttttgattttaggtgatttttttattttggttttttaaagtgttgggattataggtatgagttatcgtgtttggtcgagtttttgtatttttagtagagatggggttttattatgttggttaggttggtttcgaatttttgattttaggtgatttgttcgttttagttttttaaagtgttgggattataggtgtgagttatcgtgtttggtaggatttatttataaagttgtttttttataattggttgttgttataatgttttttgaattatttgatatagatttattttatattggttattaattattttgaatggttttttgtagagaaaggaaagaaaaaaagattaaagtaggaaaaaaatatttttatggttattttgttaaagaaggagagatttttttagaaaagattagagtggttaaaagtatggtttgtagtaagtggtataaaaatagttagagtttagaagagattataggatttgtttatagaagaaatttagtggttgggcgtagcggtttatgtttgtaattttagttttttgggaggttaaggcggggagattatttgaggttaggagttcgagattagttaatagggagaaatttcgtttttattaaaaatataaaattagttggggtggtggtatatgtttgtaattttagttatttaggaggttgaggtaggagaattatttgaattcgagggatggagagttagaggttgtagtgagttaagatcgcgttattgtattttagtttgggtaataagagaaaattttgttttaaaaaaaaaaaaaaagaaatttagtatgtagtttttttattttttgtatcgttcgggatgttttgataaatggaatgttagtgtttttttttttttgtagtgattttttttttcgtgggtttaatatagagtttacgtcgtttaggtttaatattagtttttagatttatttatggttattgtgttttatggttattttttaaagagtttgtgtgtttagtttttttttgtttttttaagtggaagttttgttggttcgttttttagttttttttttgttgagttagtttttaattaggaattatattagagttattaggattagaaaggttaggtttattcgaaggagattttgggtagtgtgattttagagggtatggtttgtaggtaggagaatagggtgatcgttgatagggatgtaaggatattttttttttttttttttttttttttttttttttttttttttttgagatagagttttagttttgtcgtttaggttggagtgtaatggtacgatttcggtttattgtaatttttattttttgggtttaagttatttttttgttttagttttttaagtagttgggattataggtatacgttattacgtttggttaatttttttgtatttttagtagagatgggatttcgttatgttggttagattggttttgaattttcgattttagatgatttgttcgtttcggttttttaaagggttgagattataggtgtgagttattgcgtttggttaaggatatttttttgtttttatttagattttttttttaggtttattttatgtttagtttttttttttagagtttatggttttagttgtttatttatttttttggagtttcgtttttgtggttaaaaggtaggtgttttaagtgtttgttgatgataagggaagtgaagaaaagaggatggttttgattttttttattttagtatttttttttttgggtttattttatgacgttttgtagttttataaggttttattttattttgcgggttttaggagttttatttagtaggtaaagtggaagggtttatagatggacgaatttgacgaggaattttattttagtatttgtgagtatgtgtttttgtattagttatgttttttattttttttttttttgagatagagttttattgtgttttagtttttggagtagttgggattataggtatatattatatatttaggtaattttttttatatttttagtagaaacggggttttgttatgttggttaggttggttttgaatttttaattttagatgatttgtttgtttcggttttttaaagggttgggatgataggtttttgaggttggagtatagtggtgtgattttagtttattgtaattttcgtttttcgagtttaagtaatttttttgttttagtttcgagtagttgtaattattggcgtgcgttattatatttaatttatgtttgtatttttagtagagatggggttttattgtgttggttaggttggttttgaatttttgattttaagtgatttagtcgtttttgttttttaaagtgttgggattatatgcgggagttattcggtttagttcgttttttatttaagttttattttttttattaagttattattatttttttttttttatatatatatatatagtgaaatttaaagttttattatttttttttttttttttttttttttttttttttttttgagacggagttttattttgtcgtttaggttggagtgtagtggcgcgattttagtttattgtaagtttcgtttttcgggtttacgttatttttttgttttagttttttgtgtagttgggattataggcgttcgttattacgttcggataatttttgtatttttttttagtagagatagggttttatcgtgttagttaggatggttttgattttttgattttatgatttatttgtttcggttttttaaagtgttgggattataggcgtgagttatcgcgtcgggttttatttttgtaattttagtcgtgcgttttaggtttattttatcgttattttttaaatattatttttaatttttttggttttatagttattattgtattattttagttatttttttgttttagggtataggtagatgttattttattttttttagagtttttttttttttgatagttatatgattaatttaagtttgaacgtatttgtttagatgttttttttttttgtgaggtttatttggataaatttatttaatattgttagttgttattttaattattgtaagtttgttttattttgttttttttttttatagtattatttttttttgtgtgttattttgacgttgatcgatggtgtgtttttttttgttagaatttaagtgttgtagagttaagatatttgtttggttgattgttatagtgtagtttattgtgtatattatgtatttgatgaatatatatatataatagttttgtttttgtttttttgtgagatggagtttcgttgtgtcgtgtagtggagtggaatgtagtggcgcgattttagtttattgtaatttttgtattttaggtttaataatttttttgttttagttttttgagtagttgggattataggcgagtattattaggttcggttaatttttgtatttttagtagagatggggttttattatgttggttaggttggtttcgaatttttgattttgtgatttaattattttggtttttcgaagtgttgggattataggtgtgagttatgatgtttagtttaagttttgtatttttagtagagatagggtttcgttatgttggttaggttggttttaaatttttgattttaaatgatgtattatttcggttttttaaagtgttgggattataggcgtgagttattacgtttggtttcgatgaatattttgaatgaatgttacgtttttagtgttattgggaggttttgatcgttcgtttgagtttagaaggattagttatttattaggaaaggtggggtttttaggtgtaaggttggtgtttttaatgtcgtttggaaaaggagataaagaaaaaaaagtaagggtttttggtttttttcggttttgttattttttttttttttttttttttttttgagatggagttttgttttgtcgtttaggttgtagtgcggtggtatgatttcggtttattataattttcgtttttcgggtttaagcgatttttttgttttagttttttgagtagttgggattataggtgttcgttattgcgtttggttaatttttgtatttttagtagagacggggttttatcgttttggttaggttggtttcgaatttttgattttgtgatttattcgttttattatttttttttttgttttttttttttttttgtttttggtgtttttttttatatgattaattaggtatttaggaagtggacgttttttggatattttttttattattttttggggattttttagggttttaggtaggatatggcggcgaagggtgtggggaattgagtatttttttatttgtgattaggagttttattggtttattggggaaagattaggtatggttgttataggagttaaaatatcggtatgtttttcggtgggttgtggttatagggtttagggggaatttcgtttggattttttcgtattcgcgttgtacgtggttggattttttttttttgagtagtaagaatatgtttgttgtagtgtttagacggtagtagaaggttattttttttttcgagattatttcgggtttaggatgaatcgagagggtgggtgtgttatatatttttatgagagaaggtggggttattatattagaaatttagtgatgagtagttagttatttttttttttttttttttagagatggagtttttttttgtcgtttaggttggagtgtagtgatacgattttggtttattgtaatttttgtttttcgggtttaagcgttttttttgttttatttttttaagtagttgggattataggggtttgttattatgtttggtagttagttttttttttttttttaattattattttggttaaatatatataatagaagatttatcgtttaaaattatttttaaaaatgatatagggttttgttttgttttttaggttggagcgtcgtggtattatttttgtttattgaagattcgattttttgggttaggagtttgagattagtttggttaatatggtgaaatttcgtttttattaaaaatgtaaaaattagtcgggtgtggtggtatatgtttgtaattttaattatttgggaggttgaggtaggagaattgaggttgaggtagaggttgtagtgagttgagattgtattattgtattgtagcgagattgttttaaaaaaaaaaaaaaaaagtttcggttagtcgtttcgttcgggaggttggggggtagttttcgttcggttattgtttcgtttgggaggtgggggggcgtttttgttcggtcgtttcgtttgggaagtgaggagtttttttgttcggtcgttatttcgtttgggaggtgtatttaatagtttattgagaatgggttatgatgacgatggcggttttgtcgaatagaaaaaggggaaatgtggggaaaagaaagagagattagattgttattgtgtttgtgtagaaagaagtagatataggagattttattttgttttgtattaagataaatttttttgttttgggatgttgttaatttatgattttatttttaatttcgtgttttttgaaatatgtgttatgtttatttagggttaaatggattaagggcggtgtaagatgtgttttgttaaatagatgtttgaaggtagtatgttttttaagagttattattattttttaattttaagtatttagggatataaatattgcggaaggtcgtagggatttttgtttaggaaagttagagatttttgtttatatgtttatttgttgattttttttttattattgttttatgattttgttaaattttttttttcgagaaatatttaagaatgattaataaatattaaaaaaattaaaaaaaaaagaataaatgagtagttgtgtttttttgttagaatttttaaataaggtttaaagattttgagtaaatgaaaaggtatagataaaaaatatatatattttaatataagtatatgatatagaatatagaaataattttttttaattaattaaaatataagtaatttaatttaaaaataggtaaaagatttaaatagatattttataaaagaagatatttgaatggatatgaaatattgttgtgagttgtataatgatattttggttaataatgtattatatatatgatggtggttttataagattataatgaaattgaaaaatttttattgtttgatgatattatagtttttttagtataaagtattgtttatgtgtttttggtgttgttggtataaataaatttaattgtatagtatatataattatgtatgtatatgtaattatgtataatatttgataataataataaataattatattgttaaaaaaaaaaaaagttaatttttttttttttttttagaaaattattatttggttgggtgtgatggtttatatttgtaattttagtattttgggagggtgaggcgggcggattatttgaggttaggagttcgatattattttggttaatatggtgaaattttatttttattaaaaatataaaatgtggcgtagtggtgggtgtttgtgattttagttatttgggaagttgaggttggagaattatttgaatttaggaggtggaggttgtagtgattggagattgtattattgtattttagtttgggtgataagagcgaaatttcgttttaaaatagataaaaaaaaaaaaaatttattatttgtgatgggtgagggaagtaaagtgtaagttattgcgtttagtttataggtattgtttttgaggatattttttagttatatttttgtatataaatatttattttagaatttgtgttatggagaaattgattgaggatatatttgtttttaggacgtagagatacggtttgtagataattttttgtaggtaaggattgtgatggggattatttttttttttagttttttatcgagataagtagtgtttgagtggggtttggaagagtttatagatgatgttgtatttcggatgtagattgagattattttttagttagagaatcggatagttatttgttattattagatttagtaagttgttgggttttgattagagttttttaattcgatagatgtagttgtattgttttgttatgcgggagtttatgttcgggatgtagaatttgattttgttaattcgtttagggggttttggtttgtttacggtaaaaaggttttttttaaagtgtagttggtatttaatagttttataatttttttggtaatagatggttatttgttttttttttggaattatgaaatggggttcggtttagatgaacggttttgggagagtttttggaagggaattagaggttggagttttagcggagttttttttttttaattttaggttttatttagttgttggttttaagtttttttgggaagttagtattttgttttttttttttagtcgtgtttgggtggaaggagtttggtttgaattcggaagagtgattttgggttttgaaggaaggatttacgttgttgggcgttgattttttgatttagatatagttttggaagacgggagtaatgagatttgttgttttttaggtatatcgtgattttattttttttttacgttagaatttatcgacgtagagtagggtagggagtgtggaagatatcgtttagattttgtcggtttagtgttgagtagtggggattgagtcgggcgggttagggagatagatatataggaagtggtgggtgagtattagcgtttattattagagcgtttttacgttgattgtttttattagaacgtttataattttttttcgtttttgattatgagtttatagaaaggtcgtggtttttttgatatatttgtggtttagttagtaattttgataattgtttgtttagtttaaaatgtatttttgggttaattttttaattttgtaatgtggaggtcgtatttagagttgattgtgggaagttgtgtttaattatgtttagaggaaattttttgagaatcgtataaaaatatagggagttttatagtgagatattggaataggaattaaaagaaattatagaatgtgtaaataaaaatttagttgtatttaagaaaatttagtttttttcgaggaagagaaagaggtggagttttttaaatatgaattgtttgtttttttgtttgtggttagtgagttttattttttttttttttaggtattgtgaagattttgttttttttgtcgtgcggttgtaagattattagataggataattttaagtcgtaaaatatattttttttgaaaagtaaggaataatgtgatgtatgttttaattgaataattgtttttgttttttgtttttgtaatatgtttttttttgtatagattttttttaattttataaaatgtttaaaaggtaatcggattttttgttcgagttttagtttttttggatgttaatttgattggggtcggtgtatttaaataataataataataataaattttttttaatttttcggtttttttgatttttaaattattttttaataatattattttatattagttagaatggttattattgaaaagttagaaattaatagatgttggtgagattgtggagtaaaggggatatttatatattgttggtgggtgtaaattagtttagttattgtggaaagtagtttggtttggagatattttagagaattataaatagagttattatttagtttagtaattttatcgttgggtatatagttaaaggaaaataaattattttattaaaaagatatatgtatttgtatgtttattgtagtaggatttataatagtgaagatatggaatttatttaggttttattagaggtggattggataaagataatgtgatatgtatatattatagaacgttatatagttttgaaaaattataagattatgttttttgtagtaatatggatgtagttagaggttattattttaagcgagttaatatagaaatagaaaattaaatattggttagatacggtggtttacgtttgttattttagtattttgggaggttgaggtaggtggattattttaggtcgggagttcgagattagtttgattaatatgtagaaattttgtttttattaaaaatttaaaattagtcgggtgtggtggtatatgtttgtagttttaattattcgggaggttgaggtaggagaattgtttgaatttggaaggtgaaggttgtagtgagtcgagatggtgttattgtattttagtttgggtaataagagtgaaattttattttaaaaaaaaaaaaaaaaaagaaaagaaaattaaatattatatgtttttatttataagtgagagcgttaaatattgggtaaggaggggagtaaggtttgaaaatttatttatttggtgattagattattaatgtaagttttagtattatgtaatatatttataaaaaatttgtatatgtatttgttgaatttaaaaagataaaaataggggttttgacgttggtttttttgtgtatagtatatatatgtttggataagttaattggttttattagaatggaatgataatattaatttttttaaagatagtgttataatgttttaataaaataaaagtgaaaagaaaagttttttatttaaagaatttaataagaaaagaaatatttttttttttttttttttttttttttttttttttttttttgagatagagttttgttttgttgtttaggttgtggtgtagtggtgtgattttagtttattgtaatttttgttttgtgggtttaagtaatttttttgttttagttatttgagtagttgggattatagatatttaatattacgtttagtttatttttgtatttttagtagagatcggtttttattacgttggttaggatggtttttaattttttattttaagtgaatttttttgtttcggttttttaaagtgttgggattataggtgtgagttattatatttagttaagaaatattttttttaagtaagtaattaattttttatttaataaaaaaaaattttatgtagaagttgttaagatttatagtaagaaaaaagaaatttatgtattttatatatatatatatatatatatatatattttttatatatatatatatatatatatttatatatatatgtatatatatatatatatatgtgtatatatattgtatagtatcgtatatgtatatatatatatgtatatatatatatatatgtatatgcgtatatatatatatatatgtatatatatatatatgtatatatgtatatatatgtatatatatatgtatgcgtgtatatatatatatatgtatatatatatatgtatgcgtgtatatatatatatatgtatatatatatatatatgcgtgtatatatatatgtatgcgtgtatatatatatatatatatatgtatatatatatatgtatatatatatgtatgtatatatgtatatatgtatatatatatatgtatatatatatgtatgtatatatatacgtatatgtgtatatatgtatatatatatatatatatatgtaaggtattatgtagtttttagtatttattggggttttggaatatattttggtggatatatgtgattattgtataagattagttgtatttttttgaggtaaataaatgtgttaatttttttttttttttttttaagacggaattttattttgttttttaagttggggtgtagtggtgtaattttagtttattgtaatttttattttttgggtttaagtaatttttttgttttagttttttaagtagttgggattataggcgtgtgttattatattcgattaatttttgtatttttagtagagatagggtttttttatgttggttaggttagtttcgaatttttgattttaagtgattagtttattttagttttttaaagtgttgggattataggcgtgagttattatatttagttcgttttttttttatttattgaagatttagtattcggtgttggcgtttttttttatatagttgttataattttgggtgttttttttatttttttttttacggagcgtttggatgttttttatggaggagatttatgtaggttggatttttagattttagttatttttttagttataatatagttatttttattaaagaaatataagaatattgttttttattattttgagtttttaattttgatataattttagatttgtaaaaatagtttaaagaatttttggttaggtgtagtggtttatatttgtaattttagtattttgggaggtcgaggtgggtggattgtttgagacgagtttgggggaaaaaaaaatgtaaaaattagttaggtgtggtgttgtgcgtttatagttttagttatttgggaggttgaggtgagagggttatttgagtttagggaggtagaagttgtagtgagttatgatcgtgttattgtattttagtttgggtgatagagtgttattttgtttataaaaaaaaaaaaaatttgtaatttttttatttagatttttttaaagttagtattttattatatttgttttattatttagttttttttttttttttttttttttcgaagaaagtgtgtttaatttgtatatgatgttttaaatttttaattattttaggttatattttttaaaattaaggatattttgttattaatgtttaaggttaagaaatagtattgatatgatattattgtttgatttatttattttatttaaattttattatttgttttattagtgatatatatttggtttaggatttaatttaagattatataatttatttaattgttatgttttttttatttggagatggaattttgttttgtagtttaggttggagtgtaatggtgtgattttagtttattgtaattttcgttttttgggtttaagtaatttttttgttttagttttttgagtagttgggattagaggtatttataattacgtttagttaatttttgtatttttagtagagatggggtttcgttaagttggttaggttggtttcgaatttttgaatttaattgatttatttgttttagttttttaaagtgttgggattagaggtatgagttattacgtttagttttttttaaaaaataaaattatagattttattttgattttattagtttttttattagtatttttttttcgttttaggagttttagtgattcgtttgttttagttttttatttgtttcggttttttaaggtattgggattataggtgtgagttatttggatttatttaatttagttttaagtttatattagtatttttgggattgttttttttttatagattttaagttatgtttgagatgatgaattttaagtcgtgatttaattatttaagtggtaagtgatatagaggatattattaatttttttttttttttttttgagatggatttttgttttgttatttatgttggagtgtagtggcgtaatttcggttcgttgtaagttttgttttcggggtttatgttatttttttgttttagttttttgagtggcgtaatttcgatttattgtaagttttgtttttcgagtttatgttatttttttgttttagttttttgagtagttaggattataggtgtttattattacgttcgggtaatttttttttttttttttttttttttaaagtagagatggggttttattatgttagttaggatggtttttattttttgatttcgtgattcgtttttttcggttttttaaagtgttgggattataggcgtgagttatcgtattcggtttttttttggtatttaaaaatataattttattgagatataatttatatgttatataattatttattaaaagtgtataatttaatggtttaaattttgtggtatttacggagttggtgtaatcgttaatatagtttaattttagaatgttgttattattgttttttagaattttatgtcgattagttgtttattattacgatttttttattttttcggttttaggtaattatttattttttgtttttaaatattagaaggtattttttaaaaattgtggtaaaatatatataatatatattttaatatttaagaagttttttaaggttaggtgtagtgggttatgtttgtaattttagtattttgggaggtcgaggtgtgcggattattaggttaggtgatttagattgttaggtttttgagtttaagttaagttattatatttttttgtggtttgtatgtatatatttagatggtcggtttttgttttaattgatgatattttattacgaaagaaatgaaaatggtttgtttttgttttaagtgatgatattattttatgaaatttttttttttggtttatttcggtttaaaagtttttttattgagtattttgtgaattttatttttgttcgttagagaataatttttttttgattgtaatttttttttatttatttaaattttataaaacggtcgtatttttatttttttttgttgattttttttttggatttagttcgtttgtatttaggtgaaataaatagttttgttgtttatataaattttgtttggtggtttttttatacggacgtgagtgaaatttggtgttataattcgaattaggggattttttttaggagattaattttttgtttttttgttttttgttttatgagaaagatttatttacgatttttcgtttttagattaattagtttaaggaatattttattaattttaaatttagtaagtagtttttttttatttttttttttaattttttttattattttttaattatttttttttttttattttttaatttttttttttttttaattttagtttttttttttttttggtagagataggagacgcgttttattcgtggatttaaaattttagcgtcggttatggattcgggaaggtagtttttttttggtgtttaattacgtagggatatttttttgattatttatttacgttttagaggtgtttgattatatggggatgtttgttttggttttttatttttagtggtaagtattgtttttttgggggggtaagaatttttaattttttttttgtgtttttattttttttttgtttttttgggggggtaagaattttttaatttttttttttttatttttagtggtaagtatcgtttttttagggggtaagaatttttcgattttttatttttgtgttttgacgttttatttttgtatttcgattttttatttttatatttcgattttttgtttttgtattttaattttttatttttgtgttttgatttttttttcgtttttttggaaggtaagaatttttgaattttttttttttatgtttttatttttttttttttttgtgtttgttttttttagtatgggtaattttttattttttatttttttttttttttttttagtttgtgtttttaaaaatttaaaatttttttaatttatatttgatttaaaatttaaatgttttatttttttttgtaatgttgtttgattttaatataaatttgatagtggttttaaatagttagaaaacggtatttttaatttttttattttataagatttaaataatttttgttgtaaaatgggtaaatggtttgaggtgtttgatatttaggtatttttttatatatcggtttttttttagtttttatgtttagtgtaattcgttttaaattttttttttttttttttcgtttgtttcgttagttttaattttaagtatcgttgagtttttttaattttttttttttatagatttatttgatatttttttttttcgttaggtcgagttgggttttaatttttttttagttttcgtttttttattttataatttttttattattttttttttttatattcggtttagtttatagttttattttatgattagtttttttttaattgtttagtaatttttttttaaaaaggtggttgaagttaaaggtatagttaaggttaatgtttttttttttttatttgattttttttaaattagatagtgtttaggtttttttttattaaatttaaaaatatagtttagtttatggtttatttggtagtaattttgagacgttttatagttttagattttaagttaaaaggtcgttttatttttaatatatattttattattaaatttgtttttaatattaaataaagttttaaaaattaaattttgttttttaaattttataataagatttaattaatttcgtttttaaggtgtatagtaatagagtagaggtagttaaatagtaatatatttttgagttgtaattttttgtttttattttagtatttagatgagataaattttagttatatttttagtatacgagaattttaaacgtttgaatcgtagttgttaggggtttttttagaatttttttttttaggagtttgttataagtattggaaatttggttattgggttaaggaatgtttatagtttgggattttttttaagtcgtattttatttgtgcgggattttattgaaaatcggattgtttaatttatttggtagttatttttagagtagttagaattttggtttaaggttttttgatttttttttagattttttcggtttagtagttgaagattgatattgttcgatttcgatcgttttagaagtttataggattattatagtttaggtaatttttatagtggaaggtaagttcgttttttttttaattaatatggaggttatttattttatattattttttttttaagggtttgttttttttgtttttataattgttgtaggtattgatagttaggtttttaaattttttaaaattttttaattttggtgttaatttagataatatttttttaagtatttttttttagttatttttatttgtttagtttttttattaggttgagatattttaattaaattatttgtttttttgattgtttttggattatagttatattttattgttgttattttttttaatttaaagttttttttgttttttttttttgtatttttttattttaatttataagtataggatatttttattttttttttggtgatcgattatgtattttttattattttattaaaatttaattatttttattttatttaacgttaatattttatttcgtagtacgttttaaaaggattaaagtttgttatagtatggttttttaaagtttataaattttttttataatttttttattttatttgttttaaaattagataaggtttatatattagtttaggatttgcgttttattaattaaattgttttgtttatttatttcgtagtgttaaatttatatatttttttatttttaatatttgtttttataatttattattttgttttggattttaaacgtgttttttttattatttttttgtattttttattttagttttttttcgtttttatttggattgattttgatatcgattaagtttagtaaattatttgggttgtattgtcgtaaagttttatagatagtttttattattttagttaagtttaaattttttttttttttgttatttatttcggtataatttttataaaaatatacgtgttttttatgtcgatcgtgtttgattgattttttaagttttagtattttttataaaataataattttttttttttttaggtatggttagcgtggtcggaatttttatataagagttaggatcgtattttgtagtttttttgttcgaataatttgattttattgttttagtttagtttttatgtttgtgagtagcggttgtcgttgttttaatagttttagaggtttttaaaattataaattatgtttaatttattttttatagtttttataatttttaaaaatttatttttttttttatatttgacgtatatattttttgtttttcggtttttttagttatatttattttttgttgagttttttataattattattgttattggtttatattttaattcggttttttatattatttcggatattatatttgatttttatgattgtatttttttgatttatttgatatttattttatttttttatattttttttttttttattttttattttaattatatttagtttattgatggtagttttattaggtttaatcgttatttattagtaaaggtaggttatgttatagtattttttatatttattattgaggttatcgttttgttttttttattattttttagtaagtcgaattagttgttttaatttaagtttttattgatgtaaaaggattatgtattaatatttatattgattttaaatatgttttttatattttgttttattatgcggttatatgggttgaaagaggtttttttattatataagggttttttatttttaatgtttttttaataaaaattttgtttaaggtcgttttatttttaaaggaagttggagttatttattgtaaaggttattaaaagttattagattttattgttttagataatgtttatgttgataaggtggttagataagtagttagttttttaatttttgttttttatatttatgtttatgttgataaggtagttagataagtagttagtatgttaatttttgttttttatagttagttttttttttttttattagttatttttatttatttttttattgaaatttttatttattaatttttttttatataaggtaaatggtttttagattaaggaaaatatttttttttagttttataggtttattttattcgg

SEQ ID NO: 33 - DNA, 25681 bp, Artificial Sequence
  chemically treated genomic DNA (Homo sapiens)
tacgtatagatagatgtatatatatatatgtatatatatagatagatgtatacgtatagttgaaggatgtataggttttttttggaagttataagtaatagtgatattttttagggaggggaattaaggaatgggaggatagtggtatggtagaaaggagattttttttgatttgtgtaattgtgtaagaaaataaatgtaatttttaaaagaaatatttttaattttattttataggtggtaggtgatatagtatgatatatagtaatgaaattttgttttacgaagtaggaaatgaagagtgtagttttgtttcgttattaagtagtagcgtgattttggaaaagttttttatttattggaggttttaatatttttttatttataattgaatagtattaaattgaattagtttttttggtggtttttggttttgaaattttttgatttttttagttagtatttgtaaggtttggagtttttgtgaggttgtagtttaatgtaaatgtgtatttgaattcgtatatatatatatatacgtttttttagaaggtaatagagtatagagttttaatttaggaaaagaggaatgttaaatttatggtcgataatattttgagaatttattgtttttcgaattagaaaaataaaatataaaaagttttttagtaaaaatttcggtcgtattagaagaattgtattgtattttattagaaatatatttttggggttgatgtgtatagtttatagaaacgtagttttgaaaatatatattatttatattttttaggagttttgaaaaatagaaagttttagtgtgttgagtaaaagtatttaaagtatttatattggtttttattaatttaagcggtagttttttttttttttttttgataagattttaaatgtttattagtaagtagggaatatgaagataattaataattatttaatttttagttttttgggtatttgatagtaaattttataaatagtatattattaaaatatttttttaagttagtggttgagattcgttattatttttttttaaataattgttacgtttataggcggtttttttatagttattacgatgttcgtacggtattgggtgaagttagttttattttagaattattaaatgtttttaggaggatttttaaaaagtttgttttttttttaattatttgtacgatttttgttttatttatgtgttattaaaaagtatttatttaatatttttagtatttaaatttatttatttattttttttttattttaaaaggaaattttatattattattgtagatggaaaattaatgttatttttataaatagaaggtagggtaaaaatataataaaaataaaatttattaaatttaagtaagatatagtggttgggtaaaggttttgagtttgaggttttatatagtttcgttttcgttaatgtttttgcggtataatttatatatatagatgttagtgttttgagtatagagtttgacgagttttgttaaatgttatatatttttgttattattaatataattaaaatatggaatatttttaagattttagaaagttaagatttaggaatagggaaagggaggagttagtgttagaaagaaaggtgttaatggtatagtagtattttattgaagcgttattttttttttgtttgtttgttttttgttttttgagatagagttttgttttgttgttaggttggagtatagtggtgcgatttcgatttattgtaattttcgtttttcgggtttaagcgatttttttgttttagttttttgagtagttgggattataggtgattattattatgttcggttaatttttttgtgtttttagtagagatagggttttattatgttggttaggttagtttcgaatttttgattttaagtgatttgtttatttcggtttgttaaagtgttgggattataggtattagttattatgtttggtttgaaattttattttttttgattagtttaaagagaaaatagcgttgaaaaatagtttttagtatatataacgtttttattggtggattatttaaaatttattttatttattatgggaggtatttggtttgtatacgaagtattagtattaaagggaggaagaagatagaagtagggatgggggatttagaggttgttgtttaagggtttttgtatttttatgttacgtatatgttgttttttttatttagaatttttttttatatttttcgattttatattttttaataagttattatttatttattatgatttgatttgagttatttttttttggaggttttttttgtttttttaggttggattaggtagtttttttatatttttaggttttatagagttttatattgaagtttatttatggatttattcgtttgtttattttttagattttgaggtttttagaggtagataggagttttatattaataattattatgaagatgattataatgtagaaaaagtagttaaaatatattgagaatttatatgttaggtattgttataagtatattatatgtagtaaattatttgatttttatagttatttatttattggatgttaatagtagttgttttgttttttttttcgttgtggtaattaaaaatgtttttaggtatcgttaaatattttttgttaggtaggttcgtttttagttgagaattacggtttttggttttagagttttagtatggtataggaggtttgcgtatagtagaggtttaaagattgttggaagtattaatttatgatttacgtttttaatttgaattgatttagaaatgagatatttttttatttttagttttggtaggtgacgtttatttttgtggtagatatttgaaagtttttatttttattatttttttttttattaagtttttgggtgtttatttaataggtaggttttgtgaatatgtggagaaatttttggttatttttaaaaattataggataagattgttggggaggttagtttagtttttttttttgttttattaagtaagagttttacgttgagatttaggttttagttaatagagggtagtacggggttaggggattttagatttatttttattttcggttgtgagatttggggaaattttatgtttttatgtgtgatacggggtgatgatattggtgatgatataagtttgtcggtttttttaatttatgtaaagtttaagatatatagaattaatatttagtaaatggggtttattggattattattgaaagaataattttttcggtgataattttgttttttttttgttatagttagtttattttataataatttgaacgtattagtttttaattttttcgaaagtattacgaaaaaaaggaagatatttttataaaaataaaatgggttggttagtattttaggaattttttttttattttagattttgttgatttttagaaaatgtgtggaggaggtaaaacgtgtttttaatattttttttattttatattttgtatttttttttttaggttatttggtagtggatcgattaaattttattaaagtgttagtgggttagtgagtcgtttgttataattaaaatattagtatatttatattatttattttatatcgagaattgtacgtatttagtgtatgtttatatttgttttataagaattttatgaagtagttgatatcgtttttttattttatatagggggaaaatgaggtttagagagggtgagtaatttgtttaaggttatatagtttttaagtagtagagttaagatttatttttaggtaatttggtttttttatttttttaattattattttattttgtattttaggaaagaggtgattttttggatggcgatattttgattttgatatagggaagtaaggatttttttcggaaaagaaattattttgggggttttattattttattcgggaggtgggttgtttttgataattgaagatatagattttttttttcgggaatgtttatagtttttttttttgttttaggattgagttaaagattattttaaaaatttatttaggttatatagtggttttcgttagcgtttttttttttggaagttttgtgagtttgttgtttattttcgtagacggatatatagttaagtttgaggtggtcgttcgtttagcgttaattcgttagttaatagattatttttgaaaaaaggaatagtaagagaatattttttttgtttagaattgtaggcgggtggaattttcgggaagtagaatcgtatgattaaaatagaaatttagttagggaatttttgagaggtagtcgtttttggggggtatagggaggggtagaggtaaatggagtttttaggtttgagtggttgggaagagagaagtagggtttggtttgggggttggatgttttttcgatgggtagtagggttatagggttttattgatttttggttaagttgattcgatttacggtttgatgagtttatttcgatgtcgaggtggcgtgagttttagggtttgggtttgggatatgatagtttgtcgttaaggtagtatttaggatgttatagttggtatcgtagatttgtagtcggaggaaaggggagtagatagagaggtaaatttcgttttttgttattcgtttcgataatttttataattttttgtttattaggggttataaagaattttaaaatagagtaggaaggtggatagattttttattcggtaggtgtgtataatttagagaaagaatttttttgaaaagtaatgggttgtttttaaataataaatttgatatttagtaaattttttgataagtttttagattattgttgtttacgttttatttagttatatatatatattatttaatagtaagtagatttttaattaatgaattatgtgtattaatgattagagttaggttgttatatttttcgttcggaggtgatatatatagatataggtttgaaagtcgagaaattttatttggataaattaggtttagaaatgttaaaaaggaaagggaggatatttgttattttgtttcgtttatggaattattggaaaaagttattttgaaggcgatgtttttgttgattttgttttagttaagatagttgtttgttttttttagacggggttgaaagaaggatttagtggtgttttttaggtaggttgtcgtaaggttaggcgtttaggatataggattgaggtgatttataagtaatgaggtttgtagattggttttggtatgatcgtttgtaaaaatatacgaatttacgcgttgatacgtattgtttttggataggggtggagaaatgtatggaatttgtaattcgtaggttttaaggttattttttagatgggggtagtagggtttaggtatgtggtatatataaggatttatttttatttttaaatttggatgggaagaattgttttttgttggttttaagttattttttggggtttttttgttttggagaattttagagatatttttatttttagttattttaatagtttatgtttattgtgtcgtaagtttttacgtgtacgtttttttgttttttttgtagtttatataaatttttggagatagttatttcgaatatttttgtgttagagatggggaaattgaggtttggggtgtagggaaatttttaagattataaaaagttagggtaaagtttgtatttaattttagggtgggggttgtagcgggggttagggggaggggtagtgtatagggggaagggttgtatatgtgtagtatgtacgtgtgtttatataagatttgtagattttattagttttgtttgtttttgagatagagttttatttttgtagtataggttatagtgtagtggcgtaattttagtttattgtaatttttgtttttagggtttaagtaatttttttgttttagtttttttagtagttggaattataggtgtttgttattatgtttagttaatttttgtatttttagtagagataggattttattatgttgtttaggttggtttcgaatttttgattttaggtgatttatttatttcggttttttagtgttgggattagaggtttgagttattgagttcggtttttattaatttttaaaatatgtattatttatatgaagtaaaatgtataaatattttatatatattttgtgtttttgtatatatatatatatattcgaatattttaagttttttagagggttttttgtggtttttttgaagttagatattttcgtttaggaagaattattttttgattttttttattatatgttgggtttgattgttttcgaatgttttataaataaaattatataggatgtatatgttttatttatttggtttagtagaatgtttgagttttatttatattgtgtgtagtagtttttttttttttattgttgtgtattattttattgttaaatttattataatttatttaattattttgttgaatttttttcgtttttaaagtatttgagattaaattcgtgatttagtaaggtttgcgtttaatagaagagagtttaatgtatgatagagaatagattttagagtggtttttttattaaaaggagaaggaaagatttggttagaagagttttttagaaatagattttagataatttttttgtaataggattcgttagggttaaatttatttattttgttaaaggtttgtagaagatgatatgagtaggggaatattttttttttttattttttgtttaatttagtaaatagttttttttttcgattagttatttttgcgagtttggttttttattgatttttatattttttcgtatagtttgaaaggttgatttttattttttttttagttaatttaaaatttaagtggaaattttttttttgaagatagtggggtttgtgtaatttttggtcggggttagagatttaaaattaatgtttttttgattgatagtttttttatttatatttttttttaggagtttttattttagtgttatgtttttgggggtgggtatattttattagtggtttttgttaattttttggttattaagatatttttttttattttatggtaatagaggtgatgttatttattgtggattttagatttgtagcgtatttttttaggattatataggtaaatagtttttttttataatttttaaaataattttagtaggtattttagatttggggtttttttttttttttatttaatatttttatttttgtaggtatgtttaagtaggtttgttttgataaggatttttataaattttgagttttgttggttatttttttttttttagatttagttgaagaaatgttttttttttaaaattttagattataaggtcgggagggttttaaatattaatttaggaaaagtaatttttttattttgtatgtggtttatagtttgtttttggtatattttttttatagagggaaaaagtattaaagatttaagtgtagggttttagatttaaatgtttaggaggtaggtaggattatttatcgggatggagaaagaaatagaaaaatagtagagttttttgttattttttatttttattttagttaggagttttttaatgagtataattttattaggatagtagtaagatataatttttaattatataaatattaattataagaggtgaacgtgtatatattttatcgtatatgagatatattagataaagttagagatagtagttttatacggtgttttgttgttttttagggttatattttggttgtgagatatagtgttgatggtagggatttagaatgtttagtgtttaagtttaaggtttgttttgttatttattaatgtaaatttttagtaaagttattttatttttaagaatttgattttattggtttaggatgtagtttgagaatttttaatgtagttaggattgagagttttttgttatttattttatattttttaaatgtatttaatttgttatttgatatggttggagagttttgagaattaatttgaataatattgttttaaagttttaggagtttttatttttgattaaaatttatgttattaaaagaatataggggtttgaatttagaagttaagatgttacgtgttttatagggaagagtgagtgaggtaattttattttttttgtttttttgtaaggtcgatgtttagttttagtttttattttatttttttagttgtatttggagacgttatttgtttaaagtaggtttattaaggtttgtttttaatttaatatagaaggtaatgtttttgaatgttatatgtgtttagtgaatttgtttgtttagtgtagaatattatttttagtaagtattaaatatatatatatatatatatatatagatattgtattatagtattttatttgtttttatttgtttattagattgtgatttatattggtttgggggttaggggaggttagatattatatttaatttgtttttatgttgttatagggtttggtataaaattagtatttagtgtgtttgttgaaagaatggggttttaattgtgttttgtgaatgggtcgagagtaggtgtttttatattgaagtgttagtaaaattagggaatgggatatagaagggtttgtgagtgttgagaaatgatattaaaagtacgtggggggatatgagagggagtggagaggggaggtggggatgtgtgggtggggggtgtagggggtatgtggtgagggggtagtgtttaggggaaagggttgtttatgtggagtatgtatacgtatcgtgtgtgtgtttatagaatttgtagattttattagttttttaaagggttgtgattttaaaagtgtaaggattataggaatagattttataaaataattagtagtgattagaaggaattagtttttttttttgaaaggtcgaagttggtattaaatgttttagtttagtagaaattgaaggagggttgtattagattgttaaggtaaagtagatgtgagtattttttatatatttgtttttaatatagtaattggagattcggtatttttggaggtgattagggatttttagtatttattcgttttttttagtgtattataagttgggagaaataagagtttattgtatttataagtatgtataagggaatttagtttttgaattgtttgttgatagttagtatattttttttttttagggtgggattagtggttttattaggatttttatatttttgtttatcgggtttttttgttattgtgtatttggttgttttttttattagaaagaaaattaagagttttttttgtatatttttagtgaatacgtttgaaatttagatagataaaatggataattttttagaaagatagagtttataaaaattgattttagtagaagtagaaagtgtaaagagattaatttttatagtatagagaaagttattaagaaataattttataaagaagtattaggtttaggcggttttatagaggaattttattatagttttagagattagggagttttagggagatagaaattatttttgagtttagaaaaggaaagaaatttaaatttgatagtataaaaaataggttaatatgaatattatttatgaatattgaaaaatgtttaaatattatttgatgttataattattttaagaaaataatatattaagtggagtttatattaaggatgtttttatataaagaaatttaataatgtatgttaatatattaataggtttacgaagaataagattatatttttttatagatgttaaaaaagtttttgatataatttaatttttatttgtaataaaaattttcgggggaaaaaagaaagaattaatattttttttatataatttatatattttaattttaaagttaatattggagtttttttttaaggtaaggatgtttattgtttttattattatgtaatattttattggaggtattagttaatgtaattagataagagaaaataatagaggtataattagaggtagtagtttagagaggataggatttgggttttatttttcgttgtgattttaggatttaatatagagggtgtttaatagttgaatgagtaaataaataatggtttatattaattgaatatttttattaataaaagtaagggtttattaaattattagtaatagattatatgttgtgttgatttaaatgggttaatttatttaaggtaggtaacggttttatgaggtaagtggtattattttagttattttatagataagtagatagatgtttagagagatgagatgatttgtttaagattattttgttggtaaataaggtttttaattttagttttgttatggttttagatattttgttaattggtttgtatgtgttttttattaaatgagagaatgaggattttaatataatagtttagaatatatggtatggagtaatattgtttattttgggaaaattattttatttttttgtgttttagcgtttttttttataaaataggggtgataatagtgtttgttttttagggttggagtggaattatatgggttaatgaacgtttgttatatgttaaattttataaaatgagtattcgatttttttaaaattttttaatttatttttattaattttattaataatgtttgttttattagtagtatttttttttttttggtttttgttaagttcgtgtttagagttaaggatagaattttatatgcgttattaatatgttgttatttgggataaaatttaataaaaagattaaggttagtgtttatttttgaggagttttattatatagaagtaaagagaggtgattgttattaatatttgggtgatttagagttagatgtatatttggggtagtttatattagttttttaaagtttattatgttttttttttttttttgtttggtttgttggtttgagatagggtttcgtattgttttatgggttggagtgtagtggtacgattacggtttagggtagtttcgaatttttggggttaagagatttttttatttaagttttcgagtagttgggaagttgggtttataggtatgcgtaattaggttaggttaattgttttatttttttatttttattagagatgaggttttgttatgttgttttagttggttttgaagttttggatttaagtaatttttttatttcgattttttaaattgttgggattgtaggtatgagttattattttcggttatagtattttttttttttttgggtgttaatttttttgtgttgtttattttttagtaaagagtaagtgttttttagattttggagtattattttgtattttttaagtgtgggttttatgtagtaatgttttttaaagagtttgaagaaattgagaaaagttatttttattgggtaattaaggttagtattaatgataaatgatatggatagtatattttttgttgttgttttttgagatagagttttatttttgttatttaggttggagtgtaatggtgttatttgttttattgtaatttttgtttattgggtttaagtaatttttttgcgttatttttttgagtttttggaattatagtgttttttattatgtttggttaatttgtgtatttttagtagagttggggttttattatgttggttaggttggttttgattttttgattttaggtgattcgttcgttttagttttttaaagtgttgggattataggcgtgagttattacgtttggttggatagtatatatttttgatacgatgtgatgagaagggagttttatttttgtgggttttttttcgaaaatttagagttttagtttaatgaagggatagtttataatataattaatattttttaaaatagtgaaggttatataaaatatttttaatttgaataaggtataaattttagttaataatgtgttaatattggtttgttggttataataaatgtattatattaatgtaaaatattaataatacggggaaatagggtattgggtatatgggaattttttgtgttatttttgtaatttttttgtaaatttgaaattgttttaaaaattgaagttttttttttgtttttttttttttgagaaaatagattttagggtttttattgtggttatttagatatttatttggtggttattaagtagtatttgttaagaaaaattataaaaagtatttttttttagatttggtttggaaattattttttcggaaatttttttattttattcgataaggaaaataaaagttgattattaatttgggaggggtgtgagtattcgttttttgaaaaatatgattttaattttaatgaatagaaagattacggatattagtgcggatcgtttgtagatttttaattgtatttttttaaagtaaaagatgttttttagattgtaattttagaagattggttttttttgttggttaattgtttttatttttagttaagatataaaattattattaatgattatttttgggtatttaagggaagaggatatttaaagttaaagtaaattttttatttaacgtggttagagaggatatcgatggaagcgaaaattttattatttgtttaatatagtgtttgtgggaaatattaggttattaagtttttttgataggttttttttacgagttagttagtataagttttttttatatattagatggaggtaagtttagagtgcgtttggaagttattaataggtttgttattgagtttttaataagtattggttgggttgggttgggttgttaaaattaggaagtttggttgggttttttgttttttttaagataatttgttaattagaaatatatagtgaggttgggcgtgtggtcgtttttttttttttttttttttttttttaacgaatgtttttgttaaatacgtgaagtgatagataagtattgggtttagttcggggaagtttttagtttttagtaattgagggtagttggaggtatagagtgataaagtttaggtagaaagagtttgtgtttttttgaatttatgttgtagttgttttttattttattttattttattatatttattaggattaagcgtagaagattatttaatatagtttagattaatttttttgtgagtggtaagtgatgggtttagtagtagaatttagggaggaaatgggtcggttttataatattaaaggttttaattttttttagtattagatagataattttttttttagttttaatataaagttttcgttaattattgtttataggaggtgatgggagttgcgtggttttattttagtgtttggagggaaggagcggttttttatttttgataattgggtttagttgtattttttttttttttttttttggtaatttttttttgttaattttatttttcgtttttttattttttttttttaaaggtatagaaattatgttttttgttttttgatagtttagttttaggtaagaggttagtagatagtattcgttttttagttttgggatttgtttgttattttttgttttgttgagagtgatttttagggagtagttatgagtaattagaaattggtgtttttaaggggtaagagggagtcgatcgttttttaagggtggtaggggttattgacgttttttttttttggtatttgggtaggggtattttttttttaggttttttaggaagggggacggttggagttaagaggatttttgtgtttagtttttaggtttgagtttttggcgggtttaggggttaggttaggggtagtttttatcgattttcgttcggatttaaatatttatagtcgaagaggatggagaagttaagttcgttttgggggttgtttttaggttcgtggtttggggcgttttcgtcgtcgggttggggttgtcgttcgggggcgtttatggcgcgtagggcgggaaggttgcggggtcgggggcgagggcgggcgcggttggttttgggatttttcgtagtggggttggcggaggcggttcgagcggcggggttttttttttcgtagggacgtacgtcgggttcggggacggcgcgtttggcgtagcgggttttggacgcgttcggggaagttgagcggcggcggcgacggcggcgcgagttttttgtttcggaggtatttgttgtagttcggggaggcggggggggggggggcgtggaggcggggatagggcggttaggtcggcgggggcggggtcgttattaggggatcggaggggaggggcgcgcggtttgggttggtcggtgtcgggaggaaggaggttgttcgcggatttgattatattgtttcgggttatcgttgggcgttggggcggtcgttgttttttattttttacgggtgagtgcgatacgcgttgcgcgaattagggtttagataagaaagttgtcgttattaggatttttgttttaagggatttattggttttatatttttttttgttttttttttttatggggtggaagggggtatttatttttttttattgtagattcgtgtttttaggcgttttcgtgtgtttacgggggcggtatgatttttatagtattttagatatttgtatggttttgaatttaattttttagcgtttaggaaggaatcggattgatagtattagtttttttcgttatagttatgttttttggttatttattacgtgttaggtgttgggtatttagtcggagttagatattgttgttttcggaagtttaggttttggtagtgggagaggtttgaaggagagaaataggataaaaagtatttgtttatggggttaggagagaatttattagggtatgggataaaggttggggtggttttagttttttgggtggttaaggaggatttttttgaggaggtgatatttgaagaaatttgattgatgaggcgattttggggaagtgtgttttggtagtgagaattaaaatatagagttagagttcgaaggggttgggtgtgttggagggagaacgaggagtatagttttgatggggcggttggtaagtgataaatacgtttggttgtttgtttaaagtatgatttttaggtttttttttggagtttttgattttataagtttgaatatagattcgtgaatgtgtatttttaattaagtatttaacgtgagtattaatgaataggtatatttggtaaatattgtataaggatttagtaattaaagaatattttttaataaaattttgttagggggttttattaatttagttgaagttggaaatagatttatagaggtagaaaagattaaaatagtggtttttaattttttttatatattagaattatttgggatatttttttaaattttcgtgttgggttgtaatttaaatttattgaagtagaatttttaatttttttttttttttttttttttttttttggagacggagtttcgttttgtcgtttaggttggagtgtagtggcgcgattttggtttattgtaagttttgttttttgggtttacgttatttttttgttttagtttttcgagtagttgggattataggcgttagttattatgtttggttatttttttgtatttttagtagagatggggttttattgtgttagttaggaaggttttgattttttgatttcgtgatttattcgtttcggtttttttaagtgttgggattataggtgtgagttattacgttcggtttgaaaatttttttaaattttagatgaatttaaggtgtagttagtgttgaggatgagaagattagacgggagaggttttaagattttcgtgagaattatagtttgattttaagtgattcgaatttttttttatgtgttaggaggaattgaggatacgtattttttaggggagttattttagttttattaaggggatttgtgttaagttatttattattttataaatatttattgagtatttgtttggtattgttataagatgttggggatgtaattattaataagttatagtttttttttttattatgtttatgttttgaaagtaaagtagtatagttatgaacggggtttttaaaattgtatttagattagtggtttttaatttagattatatattagaattatttggagagttgttaaaatttgtatttaacgatttgagtattattagatatcgatttgattagaatgtttggggttgggatttaggtattagtattttgtaaaagtttattagatgtttttaatgtgtggttagagatgagaattattttggtttagatttaaattttattgtaggggtttgggggttggtttaggaattattttagagttttgggtagtattttttggttgttagagtataaagaaattttagtttttgttttttaattataagtatttttgtgttatgtgtatttaataagtattttgggggtagttgatgtatttaggtggaggaaggaagagtgaagattttagttaggatatttatagataggtatttagaaagagatggatttttttgggtttttatgatagggatttaaggtttagatgatgaaattttggttaataaataagaaaattaggttttttttgtgatttagaaaaggagaaaagttaggaatgtttttttatattttttttcgtttttttattttataattattaagtgttattaaatttagtggatatttgttgattgtgtttatttagaataattttttttttttttttataatagtattttagtgtgttttttggggaaattattttaaatataattttggtagagttattaatttagttgttttattttttttaagtaacgaagtggatgaatgatttagattgcgttaattagagaattttatttttattaattagtttgagatttattaaggtaggggttatgattattttattcgtagttttatgtgtaatggatgtgtggataaatggaggatggataagtagatggattgatggatgggtgaatggaagatggatgtatggatggaagatggatggatggatgaatagatgggtggatggatggataggggatggattgatggatgggtgaatggaagatggatgtatggatggaagatgggtggatggatgaatagatgggtggatggatggataggggatggatggaagaatggatggatgatggatggaggagtggatggagggtggatggacggatggatggaggataaatggataaatggatgaatgaaagatatatggatggattgatggaggatagatggatgaatggatggatgaaagagtgaatgtgttgtacggatgagtggatttattaattaatggaagagtagatgtttgtttggatgaatgtagagtttgattttttttaaaatttttagagttttttttaagggttttttattttgaggtttattttggttatttaaatgttatggtaagaatttaaatttttattttaattttattttttttttagatatttaatgataaaatgagatattaaagggaagattattttgtaattgattaagtgttataaaaattttagtttgaggtaggatcgtttaggatagtttaattgtttttgttgtttttttgaatagtggatatatttttaaagtttttaggatttggagtttggattattgtagttagagttttttaaaaggaagtgttttagattaggtgttaatttataaaagagtttttgttggatagtggggagtaaaagggtttttttttttaaaggttattttgaagggtgggagtttgggttgggggaaaggtatatttttaatttaaaaataaataatttgtgtttttaggaataaggtttaggagtagaatgtatgagttttatgtatcgagagtgattttgggaggtggagggatggaggtgggatggtgatttttatagggtatcgttgttaattttttttttattttgtgtttgattttttttggatattttggtttttgagtttttttttagtttttttaatcgaagtgtaatagaaagttagtgaagttattgagattttgaaatttttagtatatattggtattatttgattttggtttaggaatttagttttttttaatatgtatttaatttatagtttaattatagattgaggtatgtgtcgtgaaaggtaaggagaatgtgttatagagtttatgttaaggaaatttgacgtagatagggaatttagataaggttgttttagggaggcgatgtttaagttgggattggaaggttggtagaagttagttagggaatgatgaggggaggtattaatagagcgatgagggagtatgtgtaaaggttttgaggtaggaggaaagtatgaaacgatggaggattcgaaagaagataggagtggtaggtgtttagggaaggatgagaagatggtgtaagattaggttgggaggtaagtggggtttaggagattatgttgagagtttgggatttgaaagtaattgggaataattggagagtgttaggtagtatatgatagaattatagacgagtttttagatgatggttttgggttttttgaggatgagaaattgtaggggtaagggttgaagtcggaggattaagtagatggtttttatagtcgtttaggaaagagataatgggggcgtagattatagagataagtggtagttatagagataagaaaatgtggaaggatttataagatttatagattgttattttttggtttttttgtgagttattttttttttttttttaggtttttttaaaatggagtataatttgggtttatttggatagaaatagttaagaagtattgattttcgaaacgtttttaagaagttttttttattatttaaggtggttttgcgtttttaggttgttttaagatggttttggagttatttattatttatagttttgtttttttttttattttttggtagaaagtttatttttatttataatttgggtttttttatagaaatttaggtttgtatatttaatgacgatttaatatttttacgggagtatttaataggtattttagtgtgaatgtgtttaaaattaaattttacgtttttagttgtttttgttttattgtgttttaatttaagtattgttttgtttgtaatttagttttttaattaaatattaaagagtggtttttgagttttcgtttttttttatgtttacgtgtaaatttttagtaaaagtaggtagttgtattaaatgtaatttaaagttatttattttttattaattttattgtttttttttttattttttaagaatttaggtttttattattttttatttggataattgtagaagttttttttttggatttgttatttttatttttgtttttatgtggagtaattagagggagtttttaaaaaatatatatttgataaattttttagtggttttttattaaattaaaattaaatataaagtttttggtttgtaaggttttacgtaagttacgttttatttgattttttttgggtattattttttgttatttttttttttttttattttttttgttattttgatcgttcgtttgttttttgataacgtttatatgattttattttagggtttttgtatttattgtttttttagatattgtttggttattattttattttgtttattttatagtttaaaagttatttgttagagattttttttgtttgttttaataaaaatcgtatttttcggtattttttgtttttttattttgttttatgttttttattgtttttttcgttatggtgtattttatttatatgtatattttttttattgtttgttttttttatttgaatgtagtttttataagggtagggatatttgtttgtttttttttttgggatatttagggttgttaagtttagtaaatataaatataggatatttagttaaatttgaattttagataatgaatgttttttttagtagaagaagtatgtttaaaatagtatgtgggatagatataaattaagaagttatttattgtttatttgaaatttaaatttaagtggatattttgtatttttatttggtaattttagttgtatttttagattttagattggtatttagtatatggtagttttttattaaaaagtagttgaaggaaagaatggaagaatggcgtttaatagagtttttatttgagattaattagtgaataaaattgtattattaggagaatttaaagttttttttttgtttagttttatgggatttaatagggatgttttgaaatttagtagtgttttgtagttttggtagtttagtttttagtttggttttaatatttgtaattatttgtagagaaataatatgttatttgatttaatggttttagggaaattttatttgtatatgttgtttaaaaagaaaaagagtttggtatagtggtgtatatttgtagttttagttatttggagattgagatggaaggatcgtttaagtttatgagtttgagacggtaatgtgtgataattttatttgtgaaaattatagtattttagtttaggtaatatagtaagatttcgtttttaaaataaggagtgagagaaaaaaaaagaatattataaaagataatgttttgttatagaaaatatgtaaatagttttttgaggttttttggtttttttgtttgtttgtttgtttgtttgtttgagatggagttttgtttttgttgtttaggttggagtgtaacggtgtaattttagtttatcgtaatttttgttttttaggtgtaagcgatttttttgttttagtttttcgaatagttgggattataggtatgtgttattatatttagttaatttgagttttttataataagattggtatatatgaattttttttattttttttaggttgatttttttgttgaaggttaatggtatgaagatataaatgtttgattaagtttggagtgattttgtgatatattaaagaataatttagagttgggaggtttaggatttaaattgagtttttttttttattttgtgatttttaagtaagatatttttagtgttttagtttttttgtttgtaaaatgggaagagatgaattagataatatttgagttattattttagttttaaaatttaaggattgtttaataaggaaaattaagttaatttgagtagtagtcggggttcgttttatgggatgtgatatgtagagttatacggtatttcgtatttggaataatttgtgtttagaaggagtttgtatttggttgaatgttttgttgttgatattttttaaattttgaatattttttgaataagaggcgatgtatttttatttcgtataatgttttgaaaattatgtagtcggttttgatagtgtataagtgttttttaatttatggtgggtgatattttaatatatttatgatatattgaatatattgttgggttgaaaatgtatttaggtagggtatggtggtttacgtttataattttagtattttgggaggttgaggtaggaggatggtttgaggttaggagtttgagattagtttaggtaatatagtaagattttgtttttatgaaaaataaaaatatattagtcgggtttttatttgagtttaggagtttgaggttgtagtgagttatgatcgtattattgtattttaaaagagtaagattttatgtttaaaaaataataataataggttaagtacggtggtttatgtaagtttgtaattttaggattttgggaagttaaggtgggtggattatttaaggttaggagttcgagattagtttggttaatgtggtgaaatttcgtttttattaaaaatataaaaaatagttaggtatggtggtgggcgtttgtaattttagttattcgggaggttgaggtaggagaatcgtttgaatttgggaggtggaggttgtagtgagtcgagattgcgttattgtattttagtttgggtgataagagcgaaattttattttaaataataataataataataataaatataaagaaaatgtatttaatatgtttaatttattgaatattatagtttagtttagtttattttaaatatgtttagaatatttatagttatttacgtaattgattttaggtaaaataatttaatataaagattattttataatgaggtgttgaatattttttgtaatttattgaatattatattaaaagagaaaaatagaatggtttatgggtatttaaagtatagtttttattgaatttatatcgtttttatattatcgtaaagaaagtttaagttaaatattataagttagagattatttgtataatatataagttatatatttttattatgaattttatgttttaataattttttattataataaaatattgtttataaaaggtaggtattgaaacgttttaagttggatttaaaaagtgggaatattttttattagattttaaaaattatttttttttaacggaagtattttttgggatttatgattattttaggtgttaatatataatttatatatagatgtatttgattttagtaaggttggtattaaggtgaggtaagagaggtaaaatgaaagagggtattaaaaatttagtaattagataaattatatttttatattatgttttaaaatattaaaatgaatgtaaaaaaaaattttcgttgaataagttattataattttaataaagatagggttagtaatagtttatgtgagttatattgtattttaaggttatagggaaaatgagtaatgttgattttgtttttatttaatatttttatttatttattttttttgagatagggttttatttagttatttaggatggagtgtagtggcgagagtatggtttattgtagttttaatttttttagtttagatgattcgtttattttagttttttagtagttggggttataggtttttgttattatgttttgttattttttttttttttttttttttggagagataaggttttattatgttgtttaggttggtttcgaatttttgggtttaagttatcgtatttggtttttttaaaaaaagtttattatggagttttggtatgataagttaaaattttaaaataaaaattttgttttaaaaatattatattaggtcgtatatagtggtttatgtttgtaattttagtatattgggaggttaaggtgggcggattatgaggttaggagattaagattattttggttaatatggtgaaatttaatttttattaaaaatataaaaagttagtcgggtgtggtggcgggtgtttgtagttttagttattcgggaggttgagggaggagaatggtatgaatttgggaggtggagtttgtagtgagttgagattacgttattgtattttagtttgggcgatagagcgaggttttattttaaaaaaaaaaaaatgtgtattaaaatatggtttattttgggtttacgtttgtaattttaatattttgggaggttaaggtgggaggatcgtttgagtttaggagtttaagattagtttgggtaatatagtgatattttatttttatgaagttgaaataggaggatggtttgagtttaggaggttgacgttgtagtgagtcgtgttcgtgttattgtattttagtttaggtgatagagtaagtatttgttttaaatatatatatattttatatatgtatgtgtgtttgtgtgtgtatatatatatatatatagtttattttgattattgaattttttgtattttgtttttttaaatgttttattggtttttttatgtttttgtaaagttatttttagggatgagttttttatagattgagaaaataagatagttttaaatttgatttgtattttaatttattattttttatagagttttttaaagttcgaagaggatttttttgttgtgagaaaattattttttaagaggggattgtagtaaaaggtcgttagttgaatatgttatttttttattgggtaggtattgatggttattagtatttcgtaagatagtagggttttattaaaagttaatatttaaattaacgggtggattgtaggaagatgttttatttgatagtagtagaagttataggtttgtaggagttttattaagtttattttgtaggtatattatgtttggtttgtttagtaatttatttttaatttgaattaatatttttattttttttaattatatattaagttttgggatatatgtgtaggacgtgtaggtttgttatattagtaaatatgtgttatggtggtttgttgtatttattaatttattatttaggtattaagttttatatgtattagttatttattttgatgttttttttttcgtatttttttggtaaggttttagtgttttttgtttttttttttgtgtttatgtcgaattaatatttttaaattgggagattttatataaaagtttaaaattttaattttttaaaaaaaaaaggtaggtagatttcgttattttaggtttatattttcgtatggattaatcggttggaggtgagtagaggttgttttttggggatgttttttttcgtttgttttagtttttatttgttttttttatttatttgttttatttgtcgggagtttgtgagtttgagcgtttgggttgtagagttttgattttttttatttggttttcgtataattattttgttttggttttgttttttttttttgttttttgttttttagtacgtttttttttgttttgggtaaaaacgtttagaaggagggtaggcgtgttgggcgcggtggtttacgtttgtaattttagtattttgggaggtcgaggtgggcggattacgaggttaggagatcgagattattttggttaatacggtgaaatttcgtttttattaaaaatataaaaaattagtcgggtatggtggtaggtgtttgtagttttagttattcgggaggttgaggtaggagaatggtatgaatttggaaggtaggagtttgtagtgagtcgagattatgttattgtattttagtttgggcgatagagtaagattttattttaaaaaaaaaaaaaaaaaagagggagggtaggtttagtaaatttgttttttttttaaacgacggtttttgattttaattgaataggagatgtcgttatttttttgttagggaggttttattttttattaaggtagaattttaaggggtagggtgggtagggttggttcgttaggggatagagtattggttaatatttgtttatttttataattattttttatttaatgtatttgttatcgtcggtttattgtttttttttagttatttaagttgtttttttttgtatgttttaagattatttttttttttatttttttttttgttatattttttgtagatttaaatatttgtatcgattttttaatttttgaagttagggagtgatgaggataagttggttgatttagaggtattcgttattagtttttattcgtataattaaattttggagtatatatttttatcgtttttaaaaaagtataagatatcg

SEQ ID NO: 34 - DNA, 25681 bp, Artificial Sequence
  chemically treated genomic DNA (Homo sapiens)
cgatgttttgtgtttttttggaggcggtgggggtgtgtgttttagggtttagttgtgcggatgggagttgatgacgggtatttttgagttagttagtttgtttttattattttttgattttaaagattaggaaatcggtatagatgtttgagtttgtaaagaatatggtagggaagagaatggagagagaaatgattttggggtatataggggaagatagtttgggtgattgaggggggatagtgggtcgacggtgataggtatattgagtgagaaatgattgtggggatgggtagatattaattaatattttattttttaacgaattagttttatttattttgttttttgaggttttattttggtagaagatggagtttttttggtagagggatggcggtattttttgtttagttaagattaaggatcgtcgtttaagggggaggtaggtttattgagtttgtttttttttttttttttttttttttttgagatggagttttgttttgtcgtttaggttggagtgtagtggtatgatttcggtttattgtaagtttttgttttttaggtttatgttatttttttgttttagtttttcgagtagttggaattataggtatttgttattatgttcggttaattttttgtatttttagtagagacggggttttatcgtgttagttaggatggtttcgattttttgatttcgtgattcgtttatttcggttttttaaagtgttgggattataggcgtgagttatcgcgtttagtacgtttgttttttttttaaacgtttttatttaagatagaggggaacgtgttagaaagtaaggaataaagaggagaaataaaattagggtaaagtagttgtgcggggattaggtggaaggaattaagattttgtagtttaggcgtttaagtttataggttttcggtaggtggaataaatgaatgaggaagataggtgggggttggggtaaacggaggagggtatttttagggaatagtttttatttatttttagtcgattggtttatacgggaatgtaggtttggagtggcgggatttgtttgttttttttttttaagaagttggaattttggatttttatgtgaaattttttaatttaaaaatgttagttcgatatggatatagggaggagaataagaagtattggggttttgttaggaaggtgcgggagggagagtattaggataaatagttaatgtatgtggggtttagtatttaggtgatgggttgatgggtgtagtaaattattatgatatatgtttattgatgtaataaatttgtacgttttgtatatgtattttagaatttaatatataattaaaaaaaataaaaatattagtttagattaaaaataaattattgggtaggttaaatataatatgtttgtaggatggatttggtggagtttttgtagatttgtgatttttattgttgttaaatggggtatttttttatagtttattcgttgatttgggtgttggtttttagtagaattttgttgttttacgaggtattgatggttattagtgtttgtttagtgggagggtggtatatttaattaacggttttttgttgtaatttttttttggaaaatagtttttttataatagagaagtttttttcgggttttaaaagattttgtaggagatgatagattggagtgtaagttaggtttgaaattgttttgtttttttaatttataaggagtttatttttaaaaatggttttgtaagagtatgaggaagttaatgaggtatttgggggagtaaaatgtaagaaatttagtaattaggatgaattatatgtatatatatatatatatatagatatatatatatatatgaaatgtatatatatttgagataggtatttgttttgttatttgggttggagtgtagtggtacgaatacggtttattgtagcgttagttttttgggtttaagttatttttttgttttagttttataaagatggggtgttattatgttgtttaggttggttttgaatttttgggtttaagcgatttttttattttggttttttaaaatgttgggattataggcgtaagtttaggatgaattatattttaatatatatttttttttttttgagatggagtttcgttttgtcgtttaggttggagtgtagtggcgtgattttagtttattgtaagttttattttttaggtttatgttattttttttttttagtttttcgagtagttgggattataggtattcgttattatattcggttaattttttgtatttttagtagagattgggttttattatgttagttaggatggttttgattttttgattttatgattcgtttattttggttttttaatgtgttgggattataggtatgagttattgtgtgcgatttaatataatatttttaaaataaaatttttgttttaaaattttggtttattatgttaaaattttatgataagttttttttaaaaaggttagatgcggtagtttgagtttaggagttcgagattaatttaggtaatatagtgagattttgtttttttagaaaaaaaaaaaaaaaaaaaatagtagggtatggtggtaggagtttgtagttttagttattaggaggttgaggtgagcggattatttgagttggggaggttgaagttgtagtgagttatgttttcgttattgtattttattttgggtgattgagtgggattttgttttaaaaaaaataaataaataaaaatgttaaataaagataagattaatattatttattttttttgtggttttagggtgtagtgtggtttatatggattgttattgattttgtttttattaaaattataatagtttgtttagcgaggatttttttttgtatttattttgatgttttaaaatatggtgtgaagatataatttatttaattattgagtttttggtgtttttttttattttattttttttgttttattttagtgttagttttgttggagttaaatgtatttgtgtataagttatatattaatatttagagtgattatgagttttagggaatgttttcgttgaagggagatggtttttggagtttggtaaagaatgtttttattttttgaatttaatttaaaacgttttaatgtttgttttttataagtagtgttttattataatgggaggttgttaggatatggagtttatgatgaaaatgtgtgatttatgtgttatatagatggtttttgatttatgatgtttgatttaggttttttttacgatggtgtgaaagcgatatgagtttagtagaaattgtattttgggtatttataaattattttgttttttttttttggtatagtatttaataaattatagaagatatttaatattttattataaagtagtttttgtgttgggttattttgtttaaaattaattgcgtaggtgattgtaaatgttttgagtatgtttaaggtaggttagattaagttatggtgtttagtgggttaagtatattaaatgtattttttttgtatttattattattattattattatttgagatggagtttcgtttttgttatttaggttggagtataatggcgtaatttcggtttattgtaatttttattttttaggtttaagcgatttttttgttttagtttttcgagtagttggaattataggcgtttattattatgtttggttattttttgtatttttagtagagacggggttttattatattggttaggttggtttcgaatttttgattttaggtgatttatttattttggttttttaaagttttgggattataggtttgtatgagttatcgtgtttggtttattattattattttttagatatggggttttatttttttggaatgtagtggtgcgattatggtttattgtagttttaagtttttgggtttaaatgggagttcggttaatgtatttttattttttatagagataggattttattatgttgtttaggttggttttaaatttttggttttaggttatttttttgttttagttttttaaagtgttgggattatagacgtgagttattatgttttgtttaaatgtatttttaatttaataatatgtttagtgtattatgggtatattgggatattatttattataagttgaggagtatttgtatattattagagtcggttatataatttttagggtattgtgcgaaatgaaaatgtatcgttttttgtttaaaaagtatttagaatttaaaaaatgttaatagtagagtatttaattaagtgtaggttttttttaagtataggttattttaggtgcggaatgtcgtgtgattttgtatgttatattttatgaagcgagtttcggttgttatttagattagtttggttttttttgttaaataatttttgaattttagagttgaaatggtaatttaggtattatttaatttatttttttttattttatagatagagaaattgaggtattgaaggtgttttgtttaaaggttatagagtgagaggaagaatttagtttggattttgggttttttagttttgggttgttttttaatgtattataagattattttaggtttggttagatatttatgtttttatgttattgatttttagtaggaaagttagtttggaaggggtggaaggggtttatatgtattagttttgttgtaaagaatttaaattagttgggtgtggtggtatatgtttataattttagttattcgggaggttgaggtaggagaatcgtttgtatttgggaggtagaagttgcggtgagttgagattgtatcgttgtattttagtttgggtaataagagtaaaattttattttaaataaataaataaataaataaataaaaaaattaaaaaattttaagaagttatttatatattttttataatagaatattgttttttataatatttttttttttttttttattttttgttttggagacggggttttgttgtgttgtttaggttgaagtgttgtggtttttataggtgaaattgttatatattgtcgttttagatttatgggtttgagcgatttttttattttagtttttaggtagttggaattataggtgtgtattattgtattaggttttttttttttttaagtaatatgtgtaggtagaatttttttgaagttattgagttagatgatatgttatttttttataaataattataggtattggaattaggttagaggttgggttgttaaggttataaaatattgttaaattttaggatatttttgttgagttttataaagttgagtaaagaagggattttgggtttttttagtggtgtagttttatttattgattgattttaggtagaagttttgttgggcgttatttttttatttttttttttagttgttttttagtgagaagttattatgtattgggtattagtttaggatttggggatatagttggggttgttagataaaaatataggatgtttatttaaatttgaattttaggtaaataatgaataattttttagtttatgtttgttttatatattattttggatatattttttttattaagaaaagtatttattgtttaaaatttaaatttaattgggtattttgtatttgtatttgttaaatttggtaattttagatattttagggaagaaaatagataaatatttttgtttttgtggggattgtatttaagtgaaaggaataggtaataaaagaaatatatatatgaataaaatatattatagcggaaagggtaatgaggaatatgaagtagggtgaggagatagagaatgtcgggggatgcgatttttattaggataggtagggaaggtttttaataggtgatttttgagttgtgaaatgaataaagtaaggtagtggttaggtaatatttgagggaatagtaagtataaaggttttggggtggggttatgtgggcgttattaaggaataggcggacgattagggtggtagagggagtaagagaaggggagaatggtaggagatgatatttaaggagagttaggtgggacgtagtttacgtagggttttgtagattaagggttttgtatttaattttaatttaatgggaagttattggagggtttattagatgtatattttttaaaggttttttttggttgttttatataggggtaaaagtagaagtagtaagtttagggaggaggtttttgtagttgtttaagtaagaaataatgaaggtttgaatttttgggaggtgggaggaagaatagtgaagttagtgagaaatgggtggttttgggttatatttggtgtaattgtttgtttttgttgagggtttgtacgtgggtatgagaaaaggcgaggatttaagaattattttttggtgtttgattggagaattggattataggtagagtaatatttgagttgaggtatagtgaggtaggaatagttggagacgtagggtttggttttggatatatttatattgaggtgtttgttagatgttttcgtggagatgttgggtcgttattggatatataagtttggatttttgtggagaggtttaggttgtagataaaaatgagttttttattagaaggtggaaaggaaggtagagttgtaggtggtgggtaattttagggttattttgaagtagtttggggacgtagagttattttgggtggtaggaggagttttttgaaggcgtttcgggagttagtgttttttgattgtttttatttaggtggatttaaattatgttttattttaaggaagtttagaagaggaagagaggtaatttatagagggattaaaggatgatagtttatgagttttgtgaatttttttatatttttttatttttatggttattatttgtttttgtagtttacgtttttattattttttttttggacggttataagaattatttatttggtttttcggttttaatttttgtttttgtaattttttatttttagagaatttagagttattatttaaaaattcgtttatgattttgttatgtgttgtttaatattttttagttgtttttaattgtttttaggttttaaatttttaatatggttttttgggttttatttattttttagtttgattttatattatttttttatttttttttgagtatttgttatttttgttttttttcgggttttttatcgttttatattttttttttgttttagagtttttatatatatttttttatcgttttgttagtatttttttttattattttttaattaatttttattaattttttagttttagtttaaatatcgtttttttagggtagttttatttgaattttttgtttacgttaggtttttttgatataagttttgtaatatattttttttgttttttacggtatatattttagtttgtaattagattgtgggttaagtgtatgttgaagggagttgagtttttgggttagggttaaatagtattaatgtgtgttagaagttttaaagttttagtggttttattagttttttgttgtatttcggttggagaggttggggaaaaatttagaggttagggtgtttaaaggaggttagatataggatagagagaaagttgatagcgatgttttgtgaagattattattttatttttatttttttattttttagagttattttcgatgtataaagtttatgtattttgtttttggattttgtttttaagagtatagattatttatttttgaattgaaaatatgttttttttttagtttaaatttttattttttaaggtaatttttagggaagaagatttttttattttttattgtttagtagaaatttttttatgggttggtatttagtttgaagtatttttttttaaagaattttgattataatagtttagattttaaattttagaagttttgaaaatatatttattgtttagagggataataaaggtagttagattgttttgaacggttttgttttaggttgaaatttttgtagtatttgattagttgtaaagtgattttttttttaatattttattttattattgggtatttgaagaggaagtggaattggggtaagaatttaggtttttgttatagtatttgggtggttagggtaagttttagggtggaggatttttaaagaaaattttaaggattttaaggagagttaaattttatatttatttaggtaaatatttatttttttattgattaatggatttatttattcgtgtaatatatttatttttttatttatttatttatttatttattttttattaatttatttatgtattttttatttatttatttatttatttattttttatttattcgtttatttattttttatttatttttttatttattatttatttatttttttatttattttttatttatttatttatttatttatttatttatttatttattttttatttatgtatttattttttatttatttatttattaatttattttttatttatttatttatttatttatttatttatttatttattttttatttatgtatttattttttatttatttatttattaatttatttatttatttattttttatttatttatatatttattgtatataaagttgcgaatgaggtggttatagtttttgttttagtggattttaggttagttagtggagataaaattttttgattggcgtagtttgggttatttatttatttcgttgtttggggaaggtggggtagttgggttgatagttttattaagattatgtttagagtagtttttttaaggaatatattggggtgttgttatgagaagaagggaggaattattttgggtaggtataattaataaatgtttattagatttagtggtatttaataattatgggatggagggacgagaaaggatgtggggaggtatttttagtttttttttttttttaaattataggggaagtttggtttttttgtttattggttaaaattttattatttggattttgggtttttgttataaggatttagaagaatttatttttttttagatatttgtttataagtattttagttggggtttttattttttttttttttatttaaatgtattagttgtttttaagatgtttgttggatatatatggtatagaagtgtttatagttaggaaataaaggttggaatttttttatgttttgataattaggaggtgttgtttaagattttgaaatgatttttgagttagtttttaggtttttgtagtagagtttgagtttaaattaaagtggtttttatttttggttatatattggaagtatttggtgagtttttataaaatattgatgtttaagttttaattttaaatattttgattaaatcgatgtttggtggtgtttaggtcgttgaatataaattttaatagttttttaggtgattttaatgtgtagtttgggttaagaattattggtttgagtgtaattttgaaaatttcgtttataattgtgttattttgtttttagggtataagtatgatgaagggagaggttgtggtttgttgatggttgtatttttaatattttgtggtagtgttaggtaggtgtttaataaatatttgtggaatgatggatggtttggtataaatttttttaatggagttgagatggtttttttgaagaatgcgtgtttttaattttttttggtatatggggaaggattcgaattatttgaggttaagttgtggtttttacgaggattttaagatttttttcgtttaatttttttatttttaatattggttgtattttagatttatttgaagtttaaaaaaatttttaggtcgggcgtggtggtttatatttgtaattttagtatttggggaggtcgaggcgggtggattacgaggttaggagattaagatttttttggttaatatagtgaaattttatttttattaaaaatataaaaaagtagttaggtatggtggttggcgtttgtagttttagttattcgggaggttgaggtaggagaatggcgtgaatttagaaggtagagtttgtaatgagttaagatcgcgttattgtattttagtttgggcgatagagcgagatttcgtttttaaaaaaaaaaaaaaaaaaaaaaaaaaaaattaggaattttgttttagtgggtttggattgtagtttagtacgggagtttaaaaaggtgttttaggtgattttaatatgtgggaagggttgaagattattgttttgattttttttatttttgtgagtttgtttttaattttagttaagttggtggagttttttggtagagttttattggagggtgttttttagttattgggtttttatgtagtgtttgttaaatgtatttgtttattaatgtttacgttgggtgtttaattaaaaatatatatttacgagtttgtatttagatttatggaattagaagttttagggaggggtttgggaattatgttttaaataagtagttaggcgtgtttgttatttgttaatcgttttattagaattgtatttttcgttttttttttagtatatttagttttttcgagttttggttttgtgttttggtttttattgttagaatatatttttttaagatcgttttattaattaggtttttttaaatgttatttttttagagaggttttttttgattatttaagggattaaagttattttaatttttattttatattttggtgagtttttttttggttttataagtagatgttttttgttttgttttttttttttaggttttttttattattagagtttgagttttcgagggtaatagtgtttggtttcggttgggtgtttagtatttggtacgtggtaggtggttaggaggtatagttgtaacgggggggattagtgttgttagttcgatttttttttaggcgttggggagttgagtttagggttatgtaggtgtttgaagtattgtgaaaattatgtcgttttcgtgggtatacggagacgtttggagatacgggtttgtaatagaagggggtggatatttttttttattttatggagaagaaaagtaggaaaaagtgtggggttagtgggttttttagggtaaaagttttagtggcggtagtttttttgtttagattttggttcgcgtagcgcgtgtcgtatttattcgtggagggtgggagatagcggtcgttttagcgtttagcggtggttcgggatagtgtggttaggttcgcggatagttttttttttttcggtatcggttagtttaggtcgcgcgtttttttttttcggttttttggtggcggtttcgttttcgtcggtttggtcgttttgttttcgtttttacgtttttttttttttcgttttttcgggttgtaataggtgttttcggagtaggaagttcgcgtcgtcgtcgtcgtcgtcgtttagttttttcgggcgcgtttaggattcgttgcgttaggcgcgtcgttttcggattcggcgtgcgtttttacgaggaaagggatttcgtcgttcgagtcgttttcgttagttttattgcgaggggttttagagttagtcgcgttcgttttcgttttcggtttcgtagttttttcgttttgcgcgttatgaacgttttcgagcggtagttttaattcgacggcggggacgttttaggttacgagtttgggggtagtttttaagacgagtttgatttttttatttttttcgattatgagtatttgaattcgaacgaaggtcggtggaggttatttttggtttggtttttgagttcgttaggggtttaggtttggggattgggtataggagtttttttggttttagtcgtttttttttttaaggggtttggagggagggtgtttttatttaggtgttagggaggggaggcgttagtggtttttgttatttttagggggcggtcggtttttttttgttttttaggggtattagtttttggttgtttatgattgttttttgagggttatttttagtaaaataaaaggtggtaggtaggttttaaggttggggggcgggtgttgtttgttggttttttgtttgggattgggttgttaaagggtaagggatatgatttttgtgtttttggagggaggaggtgaggaagcgaagaatggagttagtagggaggagttgttaaaaaaagaaggaaggggggtgtagttgaatttagttattaagggtaggaggtcgttttttttttttaggtattgaagtgaggttacgtagtttttattattttttgtgagtagtggttgacggggattttgtgttgaaattgaggaagaggttgtttgtttgatgttggagagggttaaaatttttggtattataaggtcggtttattttttttttgggttttgttgttgaatttattatttattatttataagaggattggtttgagttatattaagtgattttttacgtttagttttaatggatgtggtgggatggggtagggtgaggggtagttgtagtatggatttagaaggatataggttttttttgtttgaattttgttattttgtgtttttaattgtttttagttgttgggggttggggattttttcgggttgggtttaatgtttatttgttattttacgtgtttaataggagtattcgttagagggaggaggaggaggagggggaagcggttatacgtttaattttattgtgtatttttggttagtaggttgttttggaaaaaataaaaaatttaattaggttttttgattttgatagtttagtttagtttagttaatgtttgttgaaggtttagtggtaggtttgttagtagtttttagacgtattttgggtttgtttttatttagtgtgtaggaagggtttgtgttgattggttcgtggaggaagtttgttaaggaggtttggtggtttgatgttttttataaatattgtgttaggtagataatgaagttttcgtttttatcggtgttttttttggttacgttaggtgaggggtttgttttagttttgggtattttttttttttggatatttagagatggttattagtaataattttgtgttttggttggagatggaaataattagttaatagaagagattagttttttagagttgtaatttggaggatattttttgttttgaaaagatataattaagaatttgtaaacgattcgtattaatattcgtggtttttttgtttattaagattaaagttatgttttttagggaacgaatatttatattttttttagattggtaattagtttttattttttttgtcgggtggggtggggggattttcggggaaatagtttttaagttaaatttgaagggaggtattttttatggttttttttggtaagtgttgtttggtggttattagatgggtatttaaatgattataatgaaagttttggaatttgtttttttaaaaaaaaaaaaataaaaaaaaaattttagtttttggaatagttttagatttatagaaaagttgtaaagatagtatagagagtttttatatatttaatattttgttttttcgtgttattaatgttttatattagtatggtgtatttattgtaattaataaattaatattgatatattattaattgaggtttatgttttatttagattgggaatgttttatgtgatttttattgttttgaggagtgttggttgtattgtagattgtttttttattagattagggttttaggttttcgggaggaagtttataaagataaagttttttttttattatatcgtattaagagtatgtattatttagttaggcgtggtggtttacgtttgtaattttaatattttgggaggttgaggcgggcggattatttgaggttaggaggttaagattagtttggttaatatggtgaaattttaattttattaaaaatatataaattagttaggtatggtggaaggtattgtaattttagaaatttaggaggatgacgtaggagaattgtttgaatttagtaggtagaagttgtagtgaggtaggtggtattattgtattttagtttgggtgataagagtgagattttgttttaaaaaataataataaaaagtatattatttatgttatttattattaatgttaattttgattatttagtagaggtagttttttttagtttttttaaattttttggaaggtattattatatgaagtttatatttaaggagtatagagtaatattttagaatttggaaagtatttattttttgttgagaagtaggtagtatagaagagttagtatttagaaagagaagggatgttgtggtcgggagtggtggtttatgtttgtaattttaataatttgggaagtcgaggtgggaagattgtttgagtttagggttttaagattagttggggtaatatagtaagattttatttttaataaaaataaaaaaataaaataattagtttagtttagttgcgtatgtttgtagatttagttttttagttattcggaggtttaggtaggagaattttttaattttaggagttcgaggttgttttgagtcgtgatcgtgttattgtattttagtttatgggatagtgcgaaattttgttttaaattaataaattagataaaaaaagagaagggatatggtaagttttaagaggttaatgtgaattgttttagatgtgtatttggttttgggttatttagatgttaatagtagttatttttttttgtttttgtatggtgggattttttaggggtgaatattagttttaatttttttattaggttttgttttagatggtaatatattggtgacgtatgtaaagttttatttttaattttgggtacgagtttggtaaaaattaaggaaggaaaggtattgttaatggggtagatattgttgatagaattggtgaaggtaaattagggaattttggggaggtcggatgtttattttatggagtttagtatgtagtagacgtttattagtttatgtgattttattttaattttaggaggtaggtattattattatttttgttttatggaggaggacgttaaggtatagagaggtaaagtaatttttttaaaatgggtagtgttgttttatattatgtgttttgaattattgtgttagggtttttatttttttatttggtgagagatatatgtaaattagttagtaaggtgtttgggattatggtagggttggaattgaaaattttgtttattaataaggtgattttgagtaagttattttatttttttggatatttgtttgtttatttgtaaaatggttgaaataatattatttgttttataggatcgttatttgttttgaataggttaatttatttaaattaatatagtatgtgatttgttattagtggtttagtaaatttttgtttttgttaatggaggtgtttaattaatatgagttattgtttatttatttatttagttattgagtattttttgtgttagattttagggttataacggggaatgagatttagattttgttttttttgagttattgtttttaattgtgtttttgttgtttttttttgtttaattgtattaattaatatttttagtagagtgttatatgatagtgaagatagtgggtatttttgttttggaggaggattttagtgttggttttaaaattgaggtgtatgaattatgtaaaggaagtattagtttttttttttttttttcgagagtttttattataaatgggagttgaattatattaaaggtttttttagtatttatggaaaaatatgattttatttttcgtagatttattaatgtgttggtatatattattagatttttttatatgaagatatttttggtatggattttatttggtgtattatttttttaaggtggttgtggtattagataatatttaagtattttttagtatttatgagtgatatttatattggtttattttttgtgttattaggtttaggtttttttttttttttaagtttaggaataatttttgtttttttgggattttttggtttttaaagttgtgatagaatttttttgtgaagtcgtttggatttggtgtttttttgtggagttgttttttgatggttttttttatattgtgggaattggtttttttatattttttatttttattggagttaatttttgtaaattttatttttttgggaaattatttattttatttgtttaggttttaaacgtatttattagagatgtgtaaagaagatttttaattttttttttagtggaggagataattaagtatatagtgatagaaagattcggtgggtaaggatgtgggagttttgatggggttattgattttattttggaaggggaagatgtgttggttgttagtagatagtttagaagttgaatttttttatgtatgtttgtgaatataatggatttttattttttttaatttgtaatatattgagagagacgggtgggtattgggaatttttggttatttttagagatgtcggatttttagttattgtgttggggatagatatgtggggagtgtttatatttgttttgttttaatagtttggtgtagtttttttttaatttttgttaagttaaagtatttaatattaatttcggttttttagaaaggaaaattggttttttttgattattgttggttgttttatagagtttatttttgtgatttttatatttttgaggttatagttttttaaaaagttgatgaaatttgtagattttatagatatatatacgatgcgtgtgtatgttttatatgggtagtttttttttttgggtattgtttttttattatatattttttgtattttttatttatatatttttattttttttttttatttttttttatatttttttacgtgtttttgatgttattttttagtatttatagatttttttgtgttttattttttaattttattggtattttagtgtaggaatatttgttttcgatttatttatagggtataattaaaattttatttttttagtaaatatattgaatgttggttttgtgttaggttttgtagtagtatagggataaattagatatggtgtttggttttttttggtttttaggttaatatgggttatagtttggtaaataaatagggataaatgaggtgttgtgatatagtatttgtgtgtgtgtgtgtgtgtgtgtgtttggtgtttgttaaaaatagtgttttatattaagtaagtaggtttattaaatatatgtgatatttagagatattgttttttgtgttgagttaaagataggttttaataagtttgttttggataaataacgtttttaggtgtagttggaaaggtgaaatgagggttagaattgagtatcggttttgtagggaggtagaggaaatgaagttgttttatttatttttttttgtgaaatacgtggtattttggtttttaaatttaagtttttgtgtttttttggtggtatagattttgattaggagtagaggtttttaaaattttaaagtagtgttatttaggttggtttttaaggttttttagttatattaggtggtaggttaaatatatttgaaaaatgtagaatgggtggtaaggggtttttagttttggttgtattagaagtttttaggttgtattttggattagtgagattaggtttttgggggtaaggtaattttgttgagagtttgtattggtaagtggtagggtaggttttgaatttgggtattgagtattttaggtttttgttattagtattatattttatagttaggatgtggttttggagggtagtaggatatcgtatggagttgttgtttttagttttgtttgatgtgttttatgtacggtgggatgtgtgtacgtttattttttatagttgatatttatataattagaaattgtattttgttattgttttaatgggattatatttattggaaaatttttggttaaggtagaaatgagaaatgatagggagttttgttatttttttgtttttttttttatttcggtggatggttttgtttgttttttgggtatttggatttaaagttttgtatttgaatttttaatgttttttttttttgtggaagaaatatattaaaggtagattgtaagttatatgtagagtggggagattgttttttttgggttggtatttgggattttttcgattttgtaatttgaggttttggaaaaagagtatttttttagttgggtttgaagggaagaaagtggttagtaaagtttaggatttatgaaggtttttattaaaatagatttgtttgggtatgtttgtaaaagtgagaatgttaaatgagggggaaaaaaaattttaagtttgaaatgtttgttaaagttattttaaaggttatggaaaggggttgtttatttgtataattttaagaaggtgcgttgtaggtttaaaatttataatgggtgatattatttttgttgttatggagtagggaggaatgttttaataattagggggttggtaggggttattgatgaagtgtgtttatttttaggaatatggtattgaaatgaaagtttttggggaaaagtataaataaagaagttgttagttaagaaggtattaattttaaatttttgatttcggttaagggttatataggttttattgtttttaagggggaagtttttatttggattttaggttggttgaaagaaaaatggaaattagttttttaggttgtgcgaggggatgtggggattagtaagagattaaattcgtagaggtggttggtcggagagagggattgtttgttaagttgggtagaggatggaaagaagggatgtttttttgtttatgttattttttgtaggtttttgatagagtgggtgggtttagttttggcgagttttgttgtaggaggattatttgaagtttatttttggggaatttttttgattaaatttttttttttttttttggtgaggaagttattttgaggtttgttttttgttatgtattgaatttttttttgttagacgtagattttgttaaattacgagtttaattttaaatgttttaaaaacggagggagtttagtaaggtgattggataaattgtggtggatttgatagtgaaatagtatatagtaataaaaaagaaaggattattgtatataatgtgggtgaagtttagatattttgttgagttaaataagtgagatatatatattttgtatgattttatttatgggatattcgagaatagttaaatttagtatatggtgagaaaagttagggagtggttttttttgggcgagggtgtttggttttaggggggttatagagaattttttgggggatttgaaatgttcgagtgtgtgtatatatatgtaaaggtataagatgtatgtgaaatatttgtgtattttattttatgtaagtgatgtatattttaaaaattaatgaaggtcgggtttagtggtttaggtttttaattttagtattgggaggtcgaggtgggtggattatttaaggttaggagttcgagattagtttgggtaatatggtgaaattttgtttttattaaaaatataaaaattagttgggtatggtggtaggtatttgtaattttagttattagggaggttgaggtaggagaattgtttgaattttggaggtagaggttgtagtgagttgagattgcgttattgtattgtagtttgtgttataagagtgagattttgttttaaaaataaataaaattgatggaatttgtagattttgtatagatatacgtgtatgttatatatgtatagtttttttttttgtgtattgtttttttttttggttttcgttgtagtttttattttgaaattgaatgtaagttttgttttgattttttgtggttttgggaatttttttgtattttaagttttaatttttttatttttaatatagaggtgttcggagtagttatttttaggggtttatgtaaattgtagagagaataggggagcgtatacgtgaaagtttgcggtatagtggatataagttattagaatgattaaaaataggaatatttttggaattttttaaggtaggagggttttaggaaatggtttgaaattagtaagagatagttttttttatttagatttgaagatggagatgagtttttatgtgtgttatatgtttgggttttgttgtttttatttaaaaggtgattttgaggtttgcgggttgtagattttatatatttttttatttttatttaaaagtaatacgtgttagcgcgtgggttcgtgtgtttttgtaagcggttatgttagagttagtttgtaagttttattgtttgtggattattttagttttgtgttttgggcgtttggttttgcggtagtttgtttggaaggtattattgagttttttttttagtttcgtttggggaaggtagatagttgttttagttggggtaaggttagtaaagatatcgtttttaggatgattttttttagtggttttatggacgagataggatggtaaatgtttttttttttttttttggtatttttggatttgatttatttagatggaatttttcgatttttaggtttgtgtttgtatgtgttattttcgaacgaagggtgtgataatttgattttggttattaatatatatgatttattgattgagaatttatttattgttaggtggtgtatgtgtgtgattgggtggggcgtgggtagtagtggtttgggggtttgttagaaagtttgttgagtgttagatttgttatttggaggtaatttattgttttttaaaggggttttttttttaggttgtgtatatttgtcggatgaagaatttgtttatttttttgttttgttttgggattttttgtggtttttgatgggtaggaagttatgagagttgtcggggcgagtggtaggaggcgaggtttgtttttttgtttgtttttttttttttcggttatagatttgcggtgttagttgtggtattttaagtgttgttttggcgatagattgttatgttttaaatttaggttttgggatttacgttatttcggtatcggggtgagtttattaagtcgtgggtcggattagtttggttagggattagtggagttttgtggttttgttgtttatcggaggggtatttagtttttaggttaggttttgtttttttttttttagttatttaagtttgaaagttttatttgtttttgtttttttttgtgttttttaaggacggttgttttttagaggttttttagttgggtttttattttggttatacgattttgtttttcgaaaattttattcgtttgtagttttaggtagagaagatgtttttttgttgtttttttttttaaaagtgatttgttggttggcgggttggcgttgagcgagcggttattttagatttggttgtgtgttcgtttgcgagggtgagtaataggtttatagagtttttagggggagaggcgttggcggggattattgtgtggtttgagtggatttttaaaataatttttgatttaattttggggtaaaaggagagattgtgaatattttcgaagaaaggaatttgtgtttttagttgttaggggtagtttatttttcgagtgaaatgatgaggtttttagagtgatttttttttcgggggggatttttgtttttttgtgttagggttagggtgtcgttatttaggaaattattttttttttgagatgtaggataaagtagtggttaggggggtggaggagttaggttgtttgagaatgaattttggttttgttatttagaagttgtgtgattttgggtaaattatttattttttttgagttttattttttttttatataaaatggggaaacgatattagttgttttatagggtttttgtgagataaatatgaatatatattagatgcgtatagttttcgatataaagtaagtggtatagatgtgttagtattttgattatgataagcggtttattgatttattaatattttagtaagatttagtcgatttattgttaggtagtttgggaggaaaagtataaagtgtggaatggagagggtgttggaagtacgttttattttttttatatattttttgaaggttagtaggatttgaggtaaaaagagaatttttaaagtgttgattaatttattttatttttataaaaatgtttttttttttttcgtaatgttttcgaaggggttggggattagtgcgtttaagttgttgtaaaatagattaattatagtagggaaagggtagaattgttatcgaaaagattgtttttttaataataatttagtaggttttatttattgggtattgattttgtgtgttttgggttttgtataggttagggaaatcgataggtttgtattattattagtgttattatttcgtgttatatatgaggatatggagtttttttaagttttatagtcgggggtgggagtggatttggagttttttaatttcgtgttattttttgttgattgagatttggattttagcgtagagtttttgtttggtggggtaaagaggagggttgaattggtttttttagtaattttgttttgtagtttttgggagtggttagagatttttttatatatttatagggtttatttattgggtaagtatttaggaatttgatgaaaggaggggtgataagaatgagaatttttaggtgtttgttatagagatgagcgttatttgttagggttgagagtgagaagatgttttatttttgaattagtttaggttgagggcgtgagttatgagttgatgtttttagtagtttttgggtttttgttgtgcgtaggttttttgtgttatgttggggttttaaagttaggagtcgtggtttttagttgggggcgagtttgtttggtaggagatgtttggcgatgtttggagatatttttggttgttataacggggagagggatagggtagttgttattggtatttagtgggtaggtggttgtgaggattaagtaatttattatatgtaatgtgtttataataatgtttagtatgtaagtttttaatatattttagttgttttttttgtattataattatttttataataattattgatgtaagatttttatttgtttttaagaattttagagtttagagggtagatagacgagtgaatttatagatagattttaatgtgggattttgtgggatttgggagtgtagaagagttgtttgatttagtttggggaaatagggagggtttttaggagggggtggtttaggttaagttatgatggataaatagtggtttgttaggagatgtaaggtcgggaggtatggaagggagttttgggtaaggggaatagtatgtgcgtgatatggaggtatagaggtttttgagtagtaatttttgaattttttatttttgtttttattttttttttttttttggtattgatgtttcgtatgtaggttaggtattttttatggtaggtgaaatggattttaggtggtttattagtgaggacgttgtatgtgttaagaattattttttagcgttattttttttttgaattagttagaaggagtggagttttaggttaggtatggtggttaatgtttgtaattttagtattttggtaggtcgaggtgggtagattatttgaggttaggagttcgagattagtttgattaatatggtgaaattttgtttttattgaaaatataaaaaaattagtcgggtatggtagtggttatttgtaattttagttatttaggaggttgaggtaggagaatcgtttgaattcgggaggcggaggttgtagtgagtcgagatcgtattattgtattttagtttggtaatagagtaagattttgttttaaaaaataaaaaataaataaataaaaaaggagtagcgttttagtgaggtattgttgtattattgatatttttttttttaatattggtttttttttttttttgtttttaggttttgattttttggggttttggaaatgttttatattttgattatgttggtggtagtaagaatgtatgatatttggtaaaattcgttaaattttatatttaaaatattgatatttgtgtatatgagttatatcgtagaagtattggcgggggcggggttgtataaagttttagatttagagtttttgtttagttattgtgttttgtttgaatttagtaagttttatttttattgtatttttattttattttttatttatggaggtgatattgattttttatttgtagtagtggtgtaaagtttttttttaaaataaaaaaaaaataagtgagtgaatttaaatattagaagtattaagtaaatattttttggtggtatatggatagagtaaagatcgtgtaagtggttaaaaaaaaagtaagttttttggaaatttttttgagaatatttggtggttttgagatgaaattaattttatttagtgtcgtgcgggtatcgtgatgattgtaagaaagtcgtttgtgagcgtggtagttgtttaaggagaaatagtgacgaattttagttattgatttagagaaatattttaatgatgtgttatttgtgaaatttattgttaaatatttaggggattgagaattaaatgattattaattatttttatattttttgtttgttggtaaatatttaaagttttgttaagaggaaaaaaaaaaaattgtcgtttggattaatgaaaattaatgtaaatgttttaaatatttttgtttagtatattggagttttttgttttttagagtttttagggagtgtgagtgatgtgtgtttttaggattgcgtttttgtggattgtgtatattagttttaagggtgtgtttttgataagatatagtgtagtttttttgatacggtcggaatttttgttaagaaattttttgtgttttgtttttttggttcgaagggtagtgaatttttagaatgttgtcggttatgggtttgatatttttttttttttagattaaaattttgtgttttgttattttttaggaaggcgtgtgtgtgtgtatgtgcgaatttaaatatatatttatattaaattatagttttataagaattttaggttttatagatgttagttagaaaaattaaaggattttagagttagaagttattaaggaaattgatttagtttaatgttgtttagttataaatgagaaggtgttgaggtttttagtgggtgggggatttttttaaagttacgttgttatttagtggcggagtaggattgtattttttattttttgtttcgtaaaatagggttttattattgtatattatgttatgttatttattatttatgaaataaaattaaaaatgttttttttgggagttatatttatttttttatataattatataaattaaaggaagttttttttttgttatgttattgtttttttattttttagtttttttttttggaggatgttattattatttgtgatttttagagaaagtttgtgtattttttagttgtgcgtgtatatttgtttgtgtgtgtatatatgtgtgtgtatatttgtttgtgcgtg

SEQ ID NO: 35 - DNA, 21954 bp, Artificial Sequence
  chemically treated genomic DNA (Homo sapiens)
gagcggttgggttcgtttttgaggtcggagtggagatgatcgtagttagggtggttttgtttaagttgggttagtagagtaaggttttttttagagggtttgttttcgggataatttggagtttgtttttggggagttatatacgtttttttttattttttgttggagatttggggacgtgaagggggggttttgtgatttcggaaaaaaagtaattttttttggtaggtgatattaggtagttgcgtttcggggagttttcgtttttttgcgttttttttgacgggggtataggggtcggcgtgcgtgtgtgggtacgtagtttatttcggggagttgggattttttttttcgtatttggggaagacgaatgtcgattattggtttagatattatattatataggtatttttggaggtatttcgcggcgttattatgggaagttgcgcggatcggggttttcgcgttatagtcgaggagttttagcgtttgttaggcgggagtcgtattttcggcgaggtgttttcgggagggggcgttatagttcgtggtagtgtcggtttttcgttttaattagttcgattttcgtcgcgttagtatcgtggggagcgagtgggtttcgttcggtcgcggtttggatttggtagtcgggtttcgtgggcgttttgagtcgtggttcgtggcgcggggtgatttttgtgtttggcgtcggttttagaatttcgtttacggtttttcgcgtatacggaggttgttggggatttcgatatttgcgcgttttcgattggggttcgttttagtagtgaagatttaggtttttttttgggtcgtggttgtttttggtgttttatgggagcgttcggggtagggattcggttagtgatttgtaggatatgaggggcgagttgggagtcgattcgtttacggcgtttttttcgttatggaggttttttatttattttatttcggggttgcggttacgtattataagagtatttttaggtttgagttttttaggggtgggagtaggtagttcgtgagttcgggaaggtttgcggggtttttcgtttgttgcggatttagcgtggggtcgatcggggttggcgagggttggcgaggattggcggggattcgcggggttgagttagttttcgcgaagtttttaagtgaggaacggcgtttgtggttgcgcgtttttcgtagttaagttgtagggtttagtaggggtttaggttttgtttttttcgtagatttcggatttagggttttagtggtttcggtcggagggaaggtgacgcgtagtgggcgtagacgtagagtgcggggcgtcgaacgtgggaaggagcgggtttagcgcgttggtgagagttttaggaaattcgggagagggcggtatttattagtttttttttcgagagtaattaggtaaatcggggaaggttagaggtgggggatttgtttgagtcgggataaaaaattttggagttagggttttttaattttggagatttgtcgatttcggggcgggttttcgtatttaagtttcgagatgggatgattttttaattttcgtttagttttttttttcgttttcgtcgttttgttagtattttcgtattttttttttgggttataattttcgtttgcggaatatttgtttgaagggcgcgttagtagaagtttcgttttatattattttttttattgttttttttatttaaatcgtaggatattattttcggttttatttttatatagtattcggtagtggataaggagtaggcggattcgaatttgaatttgatagttgatgtcgtgaagtggatatttgaagtttttggtttggttttagggagcgtttagggaatgtgttaggtagtaatcgggtaagtatgagttgtagtttaattttttttttcgtgggaaaatttaagttaggacgtaatgcgaggttttttaaatttttaagattttcgggttagtttaaagagtttttagtaattcgttgttttgttttgagattattatcggtttttaagtatttaattatttaatggtagttttttgggtatatcgggtagattgataggttttatttaatatttaaatataagtttttggaggaaatttttatttgattttttttttttttattcgtcgtttattgttatttattttattaaatggaatttatttaaaatttaaatttataattattaaaaagtagttttattatatatttttgaagatttggttgtgtacgattatttaattatgtagtttaatttttgtgttgtttttatattgttaatttgatggaggagagtagattcgaggattttttaatttttaataaaaaagaagaggattttatggttggggtgaaaaggggttggtgagttacgataatggggtagtatagttttattatgtgtaaaagtatttagatatatggcgatttttttgtaataaaattttattgatgatcgtttgaaagttatggtaattttaaggttataaaatttgttataaaatattaagtagttattagtttatttgattttattttaatataaatttttataaaatattttattttgtttttttttataagtggagaaaagaagttgaagaggttaaatatagcggtttattattgaggatttaaaatttgtaatttgatattttgatttttatttttgtaaataaagtagtaaaatttatattttattttttaatgtttcgttattgtagaaaagttaatagtgtgtaaatgttattgtagaaaagataataatagttatgttttagttttaattgtttatttttagtatataatttgtgtttaattttggatggagatttttttttttttggaagatttgtaagatatatttaataattattaaagaatatttgtttttcgagttatgtaatagaagtttaagaagtaaatggttatatgttgttatgtgatttgaagagttgtttaaaatatttaattagtatttatagttattgagaggttagatgattaattattattttttgttatttttagttatgagtttaaagaaaggtagttgttttgagattggtacgtataattatattatagaaaataatttaaattgatgttttaagaaagttttaggagataaattggagtttgttaaaattattatttttggtttaattgtatgagtggatttaaattatggattagagaatagttatagaatattgataattttgagtggttttttatcgttttaaattttattttggattggttgaagttcgtgtttttttaatgttgtgtagttaaggttaatttatttgtttttggggatttgtgagtaagtatagatggtaaaggttgattttgtgttagttgtatggtgatttttttaaaatatgtaaaagtttggatatatttttttacggattgtttaaaatataagttttaagattgatttaggtatatatgtatttatgatgggtttaggaatttagatgaagaaagttaattttttaggatttcgttggaattttttttggtaatgttatgtttagttttttggtgtgtttttaagtattttatggaattttaatgagaaaataatattttaaaaattaaaattttatgtaaaatgttgtttttttttagggagtgtatgggtgtagagtgtgtgtgtgtgaggggggtgagagagagagaagaaagagagagaaagaaaaagaaagagagaaagaaaaagaaagaaagaaagaaaaagaaagagagaaagaattttagagaaaggaatagggatgaagttaagggaagagagaagtattggataaagtattataaaaagtaaatttttttagtgtttataattttttttagttggttggtatagtttgtagtaatttttattatcgttttttaatgttaggtttttagatataagtgataatatgtattaaaataaagattttgtgtttttttaagttagtattgatttttagggaggatagggaagaaagggtttatggatttataatgtagtttataggttgaatatatatttttagtagatttaagaagtaaataaggggtttaaatttagttttttgagtttgatatgtttttgaaaattttatattgtgggttatttttagagataagttgataaattttttttataaatgaattgattaaatgtattgtgatatatatatatatgtaaatttgttggtaatatttgttgtagtaaaaatagtagtgaatttaatttataatgtttatatttttttgttattaattttagtatttatttgggtttttttagatgtttggagtggtgggagtggagtaaggtaagggagaaaaaatgttttttttttaatttttgataaaaataatttttttttttttttttatttttttttttaaaatattgttttttatttaagaattagttatttagattttttattttgatttttattgttgttatagtaatatataatgatttttattttgttttatttaagtattatatttattagaaagttgtggttattaaagaagtatttatttggatttatttttttgaattattttttttatattatattttggggaaggtatggaaatgatttgagttgatttttaaagtgttttttatgttaaaaaattataagggatagtatattatgtatatattttttttttttatattttgttttgtttaaagatattagaaaatgtttacgagatattatgtttttttttaaatatttttttgagttatttggttaattgaggtttagttgtataatgagaagtatgtttttaggagggttttaaaatatatgtttgggattttttttggatagttgggtgatagagttgtgaaattttaaattatgttttgagttttggtgatacgtttaggttgtttagttttgtttttattatttttattgatataaaaaatgtttttatagaggaaaaaaagtgtagtttttatgtagtgatatttaagtgtatgttatttattttttttataaaatttaatgtatattttgttttaagggtatatatttttttatgagattaattgttttaatagaaataatgatgttttttatgtatttaatatttttattttttaaaatttttatgtgttttagtagttatatgatgaaatatatagattatgtgtatgttgtggttagaagttatggtttaatttatatataattttattaggttaattttttgttttttgtgtgtgtgtgtatatgtgtgtgtatatatatatacgttttgatgtaagagaaatagaaagttttaagtaattttgttttatagttaaaatattatagataagtttggttgtaaaagaaaatttatatttttagttattttaaaattgaaagaagaggtagggaagattttttttggaagttataatttttatatgagttatgtttgaatttttagaatataatttaaataatatatttttttattgattgtattttttttttttgggaaaattggatggataaatgttaaattttaaaataaaaattggggaagggttgaagaaaatatatttatttatattaattattattgaagaattttattttgtattagagttggagaaatgtatagtattgatttagaatgttatagttggatttagagagttttaggtatttggaaaattttcgaggtatttacggtgttttttttttgttttgaattgtttttggttatttataagttaatttgttttttttaagttttaaatttatttgttaatgtatgtagtatagtatttttatttagtaagaaagtgttaaaatttattggtatgaaatatttaaattgtaaatggaaaatttgtttagttaggtggtgttttagtattttttttttaaaatatagtagtagtagtgtttggttgttggaattggttgttggttttgttggggaggtttgtaaatgtattatgtattatatagtttgggaagtagggtgatttggatagattaaaagaattttgatttttttatgttttgatttttagggatttaatttttagttttaaattggtattatgaaggttttttatatggagtaatgggattattatttttttttttagtgaaaggggtgtttttaagaatggaaatatgtggtagggtagaatttaattttagaggaattgaatatgaattatttaggtaataaaaattgttaagggaatttgtgttgttagtttgttagaatattagatttatatttttggttttgtaggaaggtgatatggggttttttaaaggttttttgtggttatgattttggttttttatttttttaaggagtggtttattggttagttaatgtattgggttggtattttgattttgtaggaaatagaattagtttttttttttaattttttatatttattttaggagtttgataagaatggtagttttagtggtatggttgtattatgtataggatattggtttagtatttttggtgttaatttttggttttgtaatttttttttttttttttgtagttattaaatttatagtttgaatatggtatagaaatagaatttaaattgtagtattttaatgcgtaagaattgtagtaaatagaattgtaggaattggaataatatacgaaggattagtattgtttaaaaatttttttttatttttttaaattttttgtttaagagatttttttgttttttttgtttattatgtttttttttgttaattagtttgatttttattaaatgttttgttagtaatatgatttttattaaatgtattattaaaatggattacgtaatgatattatgaatttaaatatttttaagatttaaaaatgtgtaggtagttttattgaataaataatattttataaattattttttatttttgtgtaaaggatagtgtatttgttgaagaaaattagtaatatttgtttgattttcgtttttattaaaaaaaatgggttaatttatattaatttaaaaatattttattgatgaaaaatgtgaattatatgtaagtagttttttttttttttttttcgttagaaaaaaatataatagtttgtatttgttggtaaaattggtttattttgtaaagatggtattgtgttttattttttttggtttattaaagagttaaatatttttgaaattatatttattttatttttatattttttttttttagtttttgtgtgtttattgaaaatattgttgggttttttaataatttttttagaattgttttttaatcgtgtttatggagaggtggttatattttgtttttttagtggtttagatacgtagtttgtttagaaagttatagtcgttgtggaggaggtaagaggttagttttttcgttggttttggtgagggtaaaatttttaggtaggaggagtattgattggtaaagggaagaggaaagggttcgttttggattttataaattcgttttttggagtaaatagtttgtaggtagaggggtttattagagtttgtttagttttcgggagggttaattttagttagtaagaagatttgaggcgtaggatttttgcgtaggaggttgtaggaatgttttcgttagtcgtaaggtttttgttggtttgtagagttttcgtgattttcgttaagatgcgaatagtaaggttttcgtatggatcgtagtttttgttcgaaatttgaaaatattaatttgggatttcgtagttttggttttcgggttcgtttcggaggcgtatttttaatttttacggaacgaatttcgcggttaaaatgtatttttttaaggtagtaaaagtgatttttgtatttaataatttttgggttttttttttttttgattattatttttcgtagggtgcgttgaaatttttttatcgttatcgttttttataaatgaaatgatttatttattcgttgtttgtagggaatgaaaggagttgattttgattttaagatgtattttaaagaaagaaaacgtaattgtagttcggatttcgcggaggaaggttaattgattttattacgtgtattttcgagttatttgggtttagttagttgtgttaattatgggttttaattttattgtaattcggtattttttggtttgtttttattatagtggttttaaaaagaaatatatataggtatattttagaatgaattttcgggaaggtaaaggtagattttttcggtgtttgagttgatgttttgagagcgcgttgagagtttcgggtatgttttggtatttttggaaataaattgtagttaagagtacggttttttcggttttttttttgtttttttgtgcgtcgttcggtcgcgggatttttggaatatgttgtgtatcgttcgagtggttgcggattttatttcgacgttttggatagtcggggttaggaggagacgagtaggtagtttttcgtttttatttagttagttgcgattttcgcggcgtggatttttggttagtagtgaggaggataaggttgtagattttttttgttgcgggttttgggttcggttttgggcggtattttgttttttaaagtgtggaggtgggtagaagagtgtttatttttagtgtagatatttgaggtatgggggtttttttgggggttttagcgtgagttgtttttgtagattagggaaatggagagaataataatggggatatggtggaatttagatttttttttgttaattaataatatgatttcgtttagtttaagtgttttttgtgtttttatttaatgttttttgtaaaatgggaattagaataatatttttttggtatggttgttgtgtttgacgtgagtttttaataaatggtaggatgaattggagaagaatgggtttattattttttatatttttttttgtagagtttttttgttgtttttagttttttcgttttgacgtaaggatagtttataattagtgtttttgagtagtttttgggggtcgtaagagaattcgttcggtagggtatagaagatgggttttcggtgaatcgtgaaaagatatgatcgggttttttttggagtatggtggagaatgatgcggagttttggggttaatggagagttgagggtgtagagggatttgaaagggggaattaaaaatatcgggttttgaaattttgtggatttttaaaggcggtttttaattttgttaaaaattatagtgggtgcgcgatttaatttggtttttataggtggcgttgtgataaggtgcggtggtcgggagaggcggttgggggattcgaagattgcgggaaattttttgcgatttcgacgttaattcgttgtttttagttttcgttttttgttttcgagggattagttaggattgtgtaatattagttttcgttttcggagtcggtacgggggttggtgggtggcgggatgaattcggggaaggcgataggttggaaacgtagtttttcgattttgtagcgtattaattttttatcgtttcgttcgttgtttaggtgcgaggattcgttagacgttataggattgggggcgattcgtaagggtattatgttatttagaggaaacgcgtagtgagtgagttttgggttattgaaaatgggagaacgttcgagtcggttaagatgatttcggtttgcgagttgatttagatttttcggaagttagaaattgggtttagagtgggttggttttttcgttagtagttcgggtttagtcgaagtttggggtttagagggtagacgttcggttttgattagagtatagcgggttgggtttggtagtttgtaggtaatttggattttgtaataaagttgtatttaatataatttagattatagtgggagttttcgaagggttttatgtgagtttcgaaattagagtttagaggcgcggtttggttttcgtttattttttttagatagtatttaggttaataaggtttttgaaaggaggtagttttaaagtttttaggtcgatatttgagggtagggttttaaatagttgtgtttgaagaatcggtaattttgttttttttatacgtagttgtattttttttgagcgttgtagttgatggttgtatagtgattacggattgcgttttttttacgaagttgcgtaatttttgttaatgttgtaattttggtaagacgaaatttttttttttttggttagattagtttagtttttttttagggatttttttgtttttttttatttttttttatttttaggtcgtttttttttttttttgttgggattcgatttttgttcgtttttgtaatttcgtagttcggagttttgtttcgtgtattaaaatatgtttttttttatttgtagatttaataaataaacgtaattatattatatggagttttatattgtttttttgaaagtaatttcgttgttgaaaattgaaaaatgggtgtaatttgtttttagaaagtaatgttagggttacggtaatttttcgggtcgttatttatttttattttaaagtttttaggaaagatttgtttatatgttcggaaaatttttaaatgcgcgaatattagtaatttcgttcgtttttaacgcgtggggtaagggggggtggggaataattattgagtgacgttaatatggggaaattgaaaagaaatgtcgattgtttttattgtaatagaaggagtgagtaaatagaaaaattaatttcgggtgatcggaaataggtaggcggagaattaaaagcgggttttagatagtaataggttttttttttgttttcgtaaggagaaagcgggcgacgagcgttcgtagttcgtggggttgattttatttttcgtagggtttcggtcgtgtcgttgtcggatcgtagaacgtcgggacgtattttcgagttcgggttcgatttaattcgttgttattttagttatttagtggagtcgcggagagatttttgaatcgtgaggttttttgatgagaaggtggagaggttgtcgggttatttttcgagtatttttcggtcgagttttgttttttttcgtgcgtttgcggtttttttttgggttagcgcgttcgtagtttttttaagtttaggtcgtaggttagtgtgcgggcgttttttgttttttttttttattagaggatttttgagggttgtttttatttttaattttcgcgattgttttttttagtcgttattttttttcgtagcgtagattttgtaggggttagcggtttagggcggattttttttcgttttgggcgcggggcgagtttttggttgttatttgtcgttgtagttttagggaaatttagttggtcgtttattttgtaagacggggatatagtagagggtcgagttttggagaagttgggtttgtttttttttttgtatcgcgcgtaatgttttaattgattttgaagggttttgtttttattgtatttgtttttagacggttagaagttaatgtattatgaaaattttagtttcggatttcggattttggttgttttataatttttgtaattttttcgagtggataagaggcgggtatcgtcgtttgggtttcgtttggggggggggggttttgtttttagtagggggtaagttggaggaattagttttttaatattttttgttagttttgtttgttataattgtaattcggaatagaataatttttttttcgtgtatacgtatttttaattttcgttttatttttttatttatagttattattgatttgtagattcggaggagtaggttttcgggggtcggtttaggttggggatatagggaggggttttcgcgtttcgtataatttgtagtgtttgggtttgatttcggtagttttcgggtatagtttgtcgggttagattttcgttgttttttcgcgttttttcgcgggtcgttttagcgtcgggaagggggcgtcgtaggtgattgttcgcggtattgggacggttgatagatttatggagattttatagtatttggttggggttcgcgagggtagggcggagttcggtcgattcgatgttggggtttaaagtttttttagttatacgtttgggtcgagtcgtttttagagttttcggtttttgttttttttgggcgggtgtatataaggattcggttagcgtcgagtgtattggttttttttatttagtgtagtttttttttttatattttcggttcggtttttagttttttattgagtaaatatttatttagagagcgagtcgtttttcggaggaggtttcgacgcggttagggaaaggttttttggtttttttttggtttgagttagttgtaggttttattggtgttttggttttggttttaaatttttttttttagtcgaaattttttcgatttttttgagattttttgagtttagagtgagtagtgtaattaggcggtagattttagttgatttttgtttttgttttaggttttgtatttttatatttatcgggattgattagattttagtgttttttttttttttttttttattttttttttttgttttagattcgtcgtttttcggtcggttttagcgggtcgttgattatttcgttttagtattcggttcgcgtttcgggaaggttttagtattatttttttttgttgggatttcgttgattttgtttgtagtttcggttttttttgtttttagagcggggttttcggtttgtcgcggatatttagtggtttaaaatatttaaaattgattttttttgcgtttttgagaatgttaagagtatttagtatttgtaatcgtcggtatgagtggggtttgcggggagtcgttagagttgcggataggttttttgtttattgagttgttatttttggtacgtttaggggattcgtagtagttgaggttatatggttatagttaagtttagtaggtggaaagggagagatggtattgaatttatgtgagaattgggaagatgtgtggtagttgaaggagttggtaggaataagagggagttgtatgttatttttatataattagagttttaaattatattagtttttgaattagtttaggttggtgttgtagaattgttaaagttttcgtagagtttttagatttttcgcgggatatgaggttttgtttgttcgtatgcgaatatttttgtattcgtttagtagttttgtagattgtaaattttttttgggtgtacggaagtagagtagatttggcgtagaggtcgatatttattgtttgtttgtgaggggggaggaggatttttttttggttaagttgtcgggtatgtttattttttttcgtaagtttaaggtagagttataagtttttttacgatgcggtaaagttttaattaatttatttattagttttaagaaggagttgttgtttttaaaatttttagattttcgaaggttttttttgtgtaaaaatgttaggcggtgttatacgatgttatttaataggtattggaggttagattaggttgaaattgttattaagttaaattttaagaagattttaaatatttgaaattaattaataaaaagggataagtttaagtatgtttagttgtgggattttttttaagatttcgattttaaagagtggtgttttagtttatttttattttttatattttttattttgttaggtaattttgaatttagagtgtattttaattatagaagtgggaatttggagatttgtttttttgtagaagtatggttgattatagtttttttttgggtttttgtaatttattgatttgagatttgggattagttagtttttttgggtgtagatcgtagttatatatatttttggggattgttggggaagtagtttgaattttgtgtgtataaggagttttttggattgttaagtagtagtaatagagtttacgattttaagtagtataaatttttaaatttacgaaaatatttttttttttgtttattattttgatttatattttttataattttaattgtaaatattaataattttggttgtaaaaaagtatacggtatattttagattagatttatagtgaataaaagtgaaaatttagaagtaggtagaacgatagggtttttggagtttaatggaagacgagggaattatatttatgtgtagcgtcggtgtttattgttttgggattaagttttttttatatttaaataaaattttttcgagagggttcgttggtttggagaatttttataaacgttgttatcgagggttaggggtttaggatagtggttgaatgtggtagagttttgggtttcgtagtgagtgttttacgtattggtaattggtcgatttggggttgtgcgttagcgttagtcgtttgtggtttagtttttcgtatacggcgtggttcgtgtttcgagtttgtgtggttagtggttggtcggtttatttggattggggggtcgtcgtaggaagttggcggtaggaggaatttttttggttttaatagtggtttttatttgtggttcgggtttttcgtaattttttggtttttttggtcggtttatttttttatatttgcgttttcgttatttggtatggattgaagtgaggtagaatcggtaggtgatatagatttttttttgatagtttttagaggttcgtatgatagattttgttaagataatttttttatttttgtgtacggtggcgttcgttttttatttatagttttaattttaattttgagatgtttatcgtttttcggaggaggttttttcgggtttttttttttttcgagttatttatatttagattaaacgtttttatttgtttatttagtattttattagtttgattttgttgtttttttgtgtcgtttttgggaagatgttaaatatttatttttattgtatttagttatttaggtggggagttagtttgaaagagatagcggaaggagttttttggattgcgttgtcgtttatcgattcgtattaattattatgtagtttgttttcggattcgttttttttagggcgtgtttttagtgagtgatagacggagtcgttttgttttgtttagtttagtttacgttgttgtttagattgaaatgtagaatttaagttttttttatcggggtatagatttttttttattttttttttttgttttttcgttttttttttttgggaagaagcggaggcgtcggcggtcggtcgggatagtaataggtcgggttattgaggcggtgcggaaagtttttgtttgggagtgcggaattggggtcgggttggtgtattgttcggagtaatgggtgagtggcggcgggggattttgttagagtcgggaagggagggagggagcgagcgggtaagggagggagggagggagggagcgcgagggcgcgcgttattaggcgtttatattttttattgattttgttcgtgtttttataagttgtaggaatacgttaagggttagcggcgtatagtagtttaatgtgaacgttggttattgggtggttgttgatgttattttttgattttaagagaagggagttgtggtattagcgagttttttagttcgagtagtaaattaagttttgttttatacgcgcgtatatatgtaaataaaataggaaaagaaaagaaaagaaaataaataataataaataaaatattttttagttttttttagattttgtttaattggtcgggtttttagaaggaacgttggggatgggatgggtggagagagggagcggtttaaggattttagtgaggagtaggcgagaaggagtacgtttaggcgttaagatcgatttttttttttgtttcgggagatttttgaacgttcggagaggttcggtattttattattttatttggtcgtaggggttttcggtacggtaggaatgagggagggggttcgattggatagtgacggtttggggtcgttcggttatgtttagggattatatggtttggggatagttttagtagttagtaggggacgggtgcgttcgtttagttttcggatgcgtagggaggtttagtggtaggtagttgttttaagtagcgggtgcgcgtttttgcgcgttgtgtgtttattttgtagagttagttttcggggaggtgaattagttgggaggagtgttcgtgaacgggaggtcgttgtttaacgttattcggtttcgtatcgtggaattggtttaattgggtattcgatcgtgtgatattagtcgttagttacgggtttcgtacggttgcgttagtaagattttggcgcgatataacgagacgggttcgattttgttaggagttatcgggggtagtaagtttcgggttattatttttatcgtggtgaaatatattcggatttataagtagagagatttcggtattttcgtttgggagattcgggatcgtttgttggcggacggcgtgtgcgataagtataatgtgtttttcgtgagttttattagtcgtattttgcgtaataagatcggtaatttggtttagtagggttattacgatttatataagtagtattagtcgacgtcgtagttagcgttgttttataattatatttattcgtattttagttttattacggcggcggtcgttaaggtgtttacgttattcggggtgtttgttattttcggttcggtggttatgtcgcgtatttggtttttttcgtatttcgttatcgatattttgggtattcgttttattatcgattaaggtaggggtttagaggttgggcgtgtggatgtgtagcgtttgttttcgtattttcgcggaggttttagtatttgtagttttagggatattgttttttttattatttgaggtttttttttttggaaacgtaaggagtttttttagggggtgttttgattttattaatttgaaatttatgtttttggtttttttgttatatatagttttttgttttattttaaattattagatttataatatttttttatttttaatatatggttcgtattttttattttttttcgtttttcgcgtcgaggtagttttagttcggtttgtttatttggagagtgcggtcggggttggatttggggcgtagttcgggaggttcgagtttgtttggggttgtcggttgtagatttcgttgtgggtagagtagtttgtttggggattattacggtcgggagaagtttggtcgggaggagtttagtacgttttggaaattgaagtatttttcgattttggtaattaggttaaatttgtttaggtaggaagtttaaatgttatttaattggtttcgtttttatgttttattttatttttttcggaaatggaggtttcgaagttattattagtaatttgtatgtaatttatttttagacgaagttatatttatattttttttttttttttttttttttttatttattttttaatttaatagattttattgtatatattttaggaagggaagtggtattagttattgtagtgatggagataaaatgtaggtaattttatgttgtttttttattgttttttttagttttttttgagtttgttatttttttttggggttttcgggttttcgggttttcgagaatgtaagtggatatttatttagtttttgtatgttttaagtagtgttattttattgtttttttttttttttatttttgattttgtttagttttaagcgttttttttgttttgttagaaggatttttcgagtttttttgtttagttcggttttcgtaggagatttgagtttgtttttttttattgagtttttttttttttttttaaggcgttaattttttttttggtagggagaaaagaaagtttgaatgatttagatgtagaatttaaataatgtgtagatagtttatttttttaattttttagtttaaagttttaaaagtgtagaggaaaaattaaataggaaagggggaaatagtttttttaattattttttgttttttttggttgttattatattggtataattatttttttaagtaattaaagtagggttttgattttttatttttttgttttttgattgtaagtttataagagtttagttttgttttatttggagttatttggagttatagttggagagagtttgtttttgatttataggataaattgattttattgatatttaaaggaagtttttgtttatgggaaagtgtgagattagtagaaatgggggtttatagggggattttaattttttaagataattttaagtttgtgtttatcgattgttttttgtttgggaaggtaaagatagataggtagttttggattaaaatatagttttttggtgtaaatgggatttaatttaatttttgggggtggtagaggaggagatatagtgaaaaaaaaaaaaaaaaaaaaaggttgatagagtttaaaagaaaattttttttgtttagggattttattattagagtaaatgttagttgggaaagtattggagaatggaaaggagtaatttttttttttagatattattgtgattttggatgttagttttaaataatttagtttgtgatatatttgtgattataaaaatgattatttttataaaaatgtttatttttttaaagtattgtgttagatggaagtgtttaaaattaagttataatggttttgttaaattatttttttatttataggatttaaagataaatatatattgtttgtagtttttatatatttttttgaaattatatttggttattgaaaaatgttaataatttaatatttttaattttaggtattatagtaattattttatattatataattttttttgtatttttattaagaatagaaagaataattgatggtattatattttaatatttaattttatttttatttttttaatttattttatttttttttttttgtatatatattttttaaatttttttaggaaaattttgttattaatatttatggtatgtatagtggtaattgtaagatttatttttaagttatatgtatatattatatatgtaatgtgtagaggtagtgtattaaggggagttttatgtatatataaagtagaaatttgtgtatgtatattttgtattgtatcgtgggaataatttagttatttgtttgtaaaggatagtgtaggtttttttgttttttattgatataagtattagatttttatagtgtagtgagtattagtgtaggtatttttaggttagacgtttttttttttttttttagttagttttattgttaaattgttgttaatttttagtcggttttgggttaagaatgaggaggtggagaacggtacgtgtagttttaagggtttttttttcgatttaggttttttttatttttttgttttgggagagtaaaggggcgaagggaaattaaaaatcggttgaaaaagaaaaaagtgtttttttttaggcgtgggttagagaatttggaaaggtttattttgaggggagtaaaattttattaggttttgggttggaagtataggaggtcgcggttgggtttagcgttttcgggaggttaagggtagggagtcgatttaaggtttaagttttttagtttttcgtcgcgggtttgggtttcgttttaagagtggggcgcgcgggttgggttttcggtttgatatttttttttttttttattagtgagcgatagttttttttattatagttttaaggtggaggagtggagtagtttgggtcgtaataattttttcgtcgtcgtttcgtacgcggtgaacgggttggagaagggagttttggagtaggaagttaagtacggttaggtgaggaggcgagggttaggttaggtgggtcgcgtggcggcggggatttaggcgatggaatattttgtgatgggtttttttttgagtttttcgcgagagaagtttaggttggcgtttttttgttgttacgagttagatttttcgtggattggggcgaagtagaggtttgagttttggaaggcggagttggggtttcgattttcgttaggggtcgggagcgttcgttagggcgttgggggtttggggcggtagtttttcggggcgaggttttgggaagcgtttttaggtttgtcggttttcgggagtttggggaggcggttttcgaagttttttcggcggttttcgttgggggtagagttaattaaagaaggcgtttttgaagggtcgagcggagtagttttggggttttagagtcgcgtttttacgttcgcgaaacgcgcgtttcgggtttcggttttacggtgcgattgcggttgcggggtttttacgttcggatttttttttcggtggttttcggataaatacgtttggttaattttgcggagaggggtatttagataaacgtaataaagttattattttttcgattaaaggttatattgtaattttttaaggaagttagtgagaaaattttaaattatacggattggttgtggatcgtttaattttttttttttttcgttttttttttatgtttttaaaggaaaatttaaaatattcgtgtttttatttttttttcgagaaaagttaaataattattataataaaagttttagatttaagtttaaatttattatcgttttggagttaagagtttaaaatttttaaaaaatcggattttaaggtaatgtaaggtttttttagtagattttagtaggtttgtaaattttttaattttaaatttaattttaaagttttaagttatttagttttttttttattattttgaagatttaaaatttttaatgtttttttgtttgttaaaattagtttttaaaattaagtggaatttgttttttttatttatttgaaaaaatattttagttattattttttgtaataaattttatttttattttttttttttttttttattttgttgaaatagaattagaatatatattagtggttttttaatggtaaataatatagaaaatagtaaggaaagagagtttttttttttagtttgtttttattgtgaagaatgttaatgagaaatgataaggaagtttgttatttttttttattaaacgatttatttttaattcgtaatttgtaaagaaaaggtagaatagtataatggttaggagtttcgatttttggttgtacgattttttaggaaaatatttaatttttagtttttatttttttatttttaaaatagggaaatgatatttttaatttagagatgttatgagtatttaatgagataatgtaattatatggtatatagtaagtatttattaagtattgtttgtggttttaagtggtagttaaaaagatacgtgtaaaagtaagtaatatttattagagtatattttgttttgagagattatagttaaaaagttttaagagattttgttataaataatagaaagagtgtatataaagtatttattatagaagtaagtatttaataggcgtttagtgttttttattaggttattattgattggaataatattgtgaagtatagagttgaaaaagtttttaatttttatatgttattgatgaatttagtttatatattaagtagttataattttaaaaaaaattttttatatttattatttatttatttattttgagacggagtttagttttgtcgttaggttggagtgtagtggcgcgatttttatttattgtagtttttgtttttcgggtttaagcggtttttttgttttagttttttgagtagttgggattataggtacgcgtcgttatatttatttaatttttgtgtttttagtagagagagggttttattatgttggtttggttggttttgattttttgatttcgtgatttatttatttcggttttttaaagtgttgggattataggcgtgagttatcgtgtcggttagtaatt

SEQ ID NO: 36 - DNA, 21954 bp, Artificial Sequence
  chemically treated genomic DNA (Homo sapiens)
aattattggtcggtacggtggtttacgtttgtaattttagtattttgggaggtcgaggtgggtggattacgaggttaggagattaagattagttaggttaatatggtgaaattttttttttattaaaaatataaaaattaggtgggtgtggcggcgcgtgtttgtaattttagttatttaggaggttgaggtaggagaatcgtttgaattcgggaggtagaggttgtaataagtagagatcgcgttattgtattttaatttggcgatagagttagatttcgttttaaaataaataaataaataataagtataaagggttttttttgggattatgattgtttgatatataaattgggtttattaatgatatgtgggaattagaaatttttttaattttatattttataatgttattttaattaatgatgatttaataaaaagtattgagcgtttattaaatgtttgtttttatggtaggtgttttatatatattttttttattgtttgtaataaaattttttgaagttttttgattatggttttttagaataaagtatattttgataaatattatttatttttatacgtgtttttttaattgttatttagaattatagataatatttaataaatgtttattatgtgttatatggttgtattattttattgaatatttataatatttttgggttgggaatattatttttttgttttaaagatgaagaaatagagattaaaaattaaatatttttttaagaagtcgtatagttagagatcggagtttttaattattgtattattttgttttttttttgtaaattacgaattaagggtgggtcgtttagtaaaagaaaatgataaatttttttattattttttattgatattttttatagtagaaatagattaaggaaaagggttttttttttttgttattttttgtgttatttgttattggagagttattaatatgtattttgattttattttaataaaataagagagggaagaggaagtggaaatgggatttgttatagaaaataatgattaagatgtttttttaagtgaataagaggaataaattttatttaattttaaaagttgattttgatagataaaaaagtattaaaaattttaagtttttaaaataataaaaggaaaattgaatagtttgaggttttggaattgagtttgggattaagagatttgtaaatttattggggtttgttggggaaattttatattgttttaaggttcggttttttgagagttttgaatttttgattttaggacggtgatgaatttagatttaaatttggggtttttgttgtggtggttgtttagtttttttcggggggaaaataaaaatacgagtgttttaaatttttttttggagatatgagggagggacggagggaaagaaaaattaaacggtttatagttagttcgtataatttgaggtttttttattaatttttttgggagattataatgtgatttttagtcgagaaaatggtagttttgttacgtttatttgggtgttttttttcgtaggattggttaagcgtgtttgttcgagagttatcggagagaaagttcgaacgtgaggatttcgtagtcgtagtcgtatcgtggggtcgagattcggggcgcgcgtttcgcgggcgtgaaggcgcggttttgaggttttagggttgtttcgttcggttttttagaagcgttttttttggttaattttatttttaacgagagtcgtcgaaagggtttcgggagtcgtttttttaagttttcggaggtcgataggtttggaggcgttttttagagtttcgtttcggggagttgtcgttttagatttttagcgttttgacgagcgttttcggtttttggcgggggtcgaggttttagtttcgttttttaaggtttaggtttttgtttcgttttagtttacgaaggatttggttcgtagtagtaaagggacgttagtttgggtttttttcgcgggaagtttagaaagggatttattataaagtgttttatcgtttaaattttcgtcgttacgcggtttatttggtttgattttcgtttttttatttgatcgtatttggttttttgttttagggtttttttttttaattcgtttatcgcgtgcggggcggcggcggggaagttgttgcggtttaggttgttttatttttttattttggggttgtggtagggggagttgtcgtttattgatggagagaagagagggtgttaggtcggaggtttagttcgcgcgttttatttttgagacgggatttaaattcgcgacggagagttggagggtttagattttgggtcggttttttgtttttggtttttcgagggcgttgggtttagtcgcgattttttgtgtttttagtttagggtttggtgaagttttattttttttagagtaggtttttttaaattttttgatttacgtttgagggaagatattttttttttttttaatcggtttttgattttttttcgtttttttgtttttttagggtaaaggagtggaagaaatttaaatcggagaaggaatttttaaggttgtacgtgtcgttttttatttttttatttttaatttaaggtcgattgggggttgataataatttggtagtggggttggttgaaaagaaagagaggagcgtttgatttaagggtgtttgtattggtgtttattgtattgtggggatttggtatttatgttaatagagaataaaaagatttgtattgttttttgtaaataaataattaaattatttttacgatatagtgtaaaatatatatgtatagatttttgttttgtgtgtgtatagggttttttttgatatattatttttatatattatatatgtgatatgtgtatatgatttaaaaataaattttgtaattattattatatatgttatgggtgttagtggtagggtttttttgaaagagtttaaaaaatgtatatataagaaagagaaaatgaaataggttaagaaaatgaaagtaaaattaagtgttaaggtgtaatgttattagttattttttttgtttttggtggagatgtaaagaaaattgtatggtgtaaagtaattattataatatttggggttgagaatattgaattattggtattttttagtgattaggtatagttttaaagagatatgtgaaggttataaataatgtatgtttgtttttgggttttatgggtggaggagtggtttggtaaagttattgtaatttgattttaaatatttttatttaatatagtgttttaaaagagtgagtatttttgtagaaatgattatttttataattataaatgtgttataaattgggttgtttaaagttggtatttaaaattataataatatttgaaaggaaaagttgtttttttttattttttaatatttttttaattgatatttgttttgatggtaggatttttaggtaggaaaagtttttttttaaattttgttagttttttttttttttttttttttttattatgtttttttttttattatttttaagaattagattgagttttatttgtattaggaaattgtgttttggtttagaattgtttgtttgtttttgtttttttagataaaaggtagtcggtgggtataagtttgaagttattttaagaaattgagatttttttgtgagtttttatttttgttgattttatatttttttatgaataggggttttttttaaatgttagtgaggttagtttattttataaattaagggtaaattttttttaattatggttttaagtagttttaaataagataaaattgggtttttgtaaatttgtagttagaaaataagaagatgagaaattagagttttgttttaattatttaaaaagataattgtgttaatgtggtggtaattaagaaaggtaggaagtaattaaagaaattattttttttttttttatttaattttttttttatatttttaaaattttaggttgagaaattaagaaagtggattatttatatattatttaaattttgtatttaggttatttagatttttttttttttttattaagaaaaaagttaacgttttaaaaaaaaaaaaaaaaatttagtaaaagaaaataaatttaggttttttgcggaagtcggattgggtaggagggttcggggaatttttttgataaggtagaaaggacgtttaggattaggtaaggttaggggtgagaaaggaaagaaatagtggggtggtattgtttaaaatatgtaggaattagatagatatttatttgtattttcggggattcggggattcggggattttaaaggaaagtggtaggtttagggaaaattgaaaagaatagtaaaaggatagtatggaattgtttgtattttatttttattattgtagtggttgatgttatttttttttttaagatatatatagtgaagtttgttaagttagaaagtgaatggagagagaaagagagagagagagaatgtgaatatgatttcgtttgggaatgagttatatgtaagttattagtagtaatttcgggatttttattttcgaggaaaatgaagtgaagtataagaacgaaattaattaggtgatatttgaattttttgtttgagtaaatttggtttgattattagaatcggagaatattttaatttttaaggcgtgttggatttttttcggttagatttttttcggtcgtagtgatttttaagtaagttgttttgtttatagcggagtttgtagtcggtagttttaagtaggttcgggtttttcgggttgcgttttaagtttagtttcggtcgtattttttaagtgagtaagtcgggttgaggttgtttcggcgcgagaggcgggggagggtggaaaatgcgaattatgtgttggggatggggggatgttatgggtttggtagtttgagatgaggtagaagattgtgtgtggtaaggaaattaggggtatgagttttaagttaatgagattagaatattttttaggaagattttttacgtttttaaaggaaaaagttttaggtggtgggaaagatagtgtttttgaggttgtagatattgggattttcgcgagagtgcgggggtagacgttgtatatttatacgtttagtttttgagtttttattttggtcggtgatggagcggatgtttaggatgtcggtgacggagtgcgaggagggttaggtgcgcggtatggttatcgaatcggggatggtaggtatttcgggtggcgtgggtattttggcggtcgtcgtcgtgatagggttggggtacgagtagatgtggttgtagggtagcgttggttgcggcgtcggttggtgttgtttgtatgagtcgtaatgattttgttgggttaagttgtcgattttgttgcgtagaatgcggttgatggagtttacggagggtatattgtatttgtcgtatacgtcgttcgttagtaggcggtttcggattttttaggcgaagatgtcggggtttttttgtttgtaggttcggatgtgttttattacggtgggggtagtgattcggggtttgttgttttcgatggtttttggtaagatcgagttcgtttcgttgtatcgcgttaggattttgttgacgtagtcgtgcgagattcgtagttggcggttgatgttatacggtcggatgtttagttgggttagttttacgatgcgaagtcggatggcgttgggtagcggtttttcgtttacgaatattttttttagttggtttattttttcgaaggttggttttgtaaaatgaatatatagcgcgtagggacgcgtattcgttgtttgggatagttgtttgttattgggtttttttacgtattcggggattgggcgaacgtattcgttttttattaattattggggttgtttttaaattatatggtttttgaatatagtcgaacggttttaaatcgttattgtttaatcggatttttttttttatttttgtcgtgtcggaggtttttacggttaagtaaagtggtgagatgtcgggttttttcgagcgtttaaaagtttttcgaagtagggggagaaatcggttttgacgtttgaacgtgttttttttcgtttgttttttattaaagtttttgagtcgttttttttttttatttattttatttttagcgttttttttggagattcggttagttaaataaagtttaggggaagttagagggtgttttatttgttgttgtttgttttttttttttttttttttttgttttgtttgtatgtgtgcgcgcgtgtgaaataaaatttggtttgttattcgggttgaggggttcgttgatgttatagttttttttttttaaaattagaaaatggtattaatagttatttagtagttagcgtttatattgaattgttgtgcgtcgttgatttttagcgtgtttttataatttgtaggaatacgagtaaagttaatagagaatgtgagcgtttagtggcgcgcgttttcgcgtttttttttttttttttttttttgttcgttcgtttttttttttttttttcggttttgatagagtttttcgtcgttatttatttattgtttcgagtagtatattaattcggttttagtttcgtatttttagatagaaatttttcgtatcgttttagtggttcggtttgttgttatttcggtcgatcgtcggcgttttcgtttttttttaggaggaggaggcgagagggtaaaaggaagaagtaaaaggaagtttgtgtttcgatgaaagaggtttgagttttgtattttaatttaagtagtaacgtgggttgggttgagtagggtagggcggtttcgtttattatttattggggatacgttttaaaaggggcgggttcgagggtaagttgtatggtgattggtgcgggtcggtgagcgatagcgtagtttaggaaatttttttcgttgttttttttaggttagttttttatttgggtgattaaatataatgaaaatgggtgtttgatatttttttagaagcggtataaaaagatagtaaaattaggttggtaaaatgttgaataaataaatgaaagcgtttggtttgaatgtgaatgattcgaagggagaaggggttcgaggagatttttttcggggaacgatggatattttagaattgaagttaaggttataggtgggaggcgggcgttatcgtgtataggggtgagggagttgttttagtaaaatttgttatgcgggtttttggggattgttaggagaggatttgtgttatttgtcgattttattttattttagtttatgttaggtggcgagagcgtaggtgtgagaagataggtcggttaaagaaattaggaggttgcggggagttcgagttataggtgggggttattgttaaggttagggaggttttttttatcgttagttttttgcggcgattttttagtttaggtggatcggttaattattagttatataggttcgaggtacgggttacgtcgtgtgcggggaattgaattataggcggttaacgttagcgtatagttttaagtcgattaattgttagtgcgtggggtatttattacggagtttaaggttttgttatatttagttattgttttgggtttttggttttcggtggtagcgtttgtgagggttttttaaattagcgagttttttcgaaagagttttgtttaaatatgaaagagatttagttttaagatagtggatatcgacgttgtatatggatgtaattttttcgttttttattaagttttagaggttttgtcgttttgtttatttttgaatttttatttttatttattgtaagtttaatttaaagtgtatcgtatgtttttttgtagttaaagttattaatatttgtagttagggttgtggagaatgtgaattaaaataataaataagaagagaaatattttcgtgaatttgggagtttgtattgtttggggtcgtgaattttgttattgttatttgataatttagaaggttttttgtgtatataggatttaggttgtttttttaatagtttttagggatgtgtgtggttgcggtttatatttagagaagttgattggttttagattttaggttagtaagttgtaagaatttaggaaaaaattatgattagttatgtttttgtaaaggaatagatttttagatttttatttttatggttaggatgtattttaaatttaaaattatttaatagaatggaggatgtgaaaggtaaagatgaattaaaatattattttttagaatcggaattttgggggaaattttataattagatatatttgaatttgtttttttttgttggttggttttaaatgtttaaaatttttttgaagtttgatttgatagtaattttagtttggtttgatttttaatatttgttgggtgatatcgtgtggtatcgtttggtatttttatataaggagagttttcggaaatttaaagattttagaagtagtagtttttttttaaggttggtagataaattagttgagattttgtcgtatcgtaggggagtttatgattttgttttaggtttgcgggagggaatgaatatgttcggtaatttgattaggaaggaatttttttttttttttatagataggtagtgagtatcgatttttgcgttaaatttgttttattttcgtgtatttagggaaaatttgtagtttgtagggttgttaggcgggtataaggatgttcgtatacgaataggtaagattttatgtttcgcggggggtttggggattttgcgagagttttagtagttttgtagtattagtttagattggtttagaaattgatatggtttagagttttggttatatggaggtaatatataatttttttttgtttttattaatttttttagttgttatatatttttttagtttttatataggtttaatgttatttttttttttttatttgttgaatttggttgtgattatgtggttttagttgttgcggattttttgggcgtgttaggggtagtaatttagtgggtagggggtttgttcgtagttttggcggtttttcgtaggttttatttatgtcggcggttgtaggtattgggtgtttttggtatttttaagagcgtaggaagagttaattttaggtgttttgggttattaagtattcgcggtaagtcgaagatttcgttttgggagtaagagaagtcgaagttgtagatagggttagcgggattttagtagaagagggtgatgttgaagttttttcggggcgcggatcgagtgttagggcgaggtagttagcgattcgttgagatcgatcgagagacgacggatttgaggtagagaaagaggatgaaggaaggaaaagagagaatattaaggtttggttagtttcgatgaatgtaaggatgtaggatttagaataagaataagggttagttggagtttgtcgtttggttatattgtttattttggatttagaagattttaaagagatcggaagaatttcgattaaaaggagaaatttaagattaaaattaaaatattagtaaggtttgtagttggtttaggttagggagaagttaaaaagtttttttttagtcgcgtcgaggtttttttcgaggggcgattcgttttttggataaatatttatttagtgggagattggaagtcgggtcgagagtgtgaaggagggggttatattgggtgggaggaattagtatattcggcgttggtcggatttttgtgtatattcgtttaaggggagtaggggtcggggattttgggggcgattcggtttaggcgtgtggttggggaagttttagattttagtatcggatcgatcggatttcgttttgttttcgcggattttagttagatgttgtgaagtttttataaatttgttagtcgttttagtgtcgcgggtagttatttgcggcgtttttttttcggcgttagagcggttcgcggagagacgcggagaagtaacgggaatttagttcggtagattgtattcgagggttgtcgaagttagatttaagtattataggttgtgcggaacgcgaggatttttttttgtatttttaatttggatcgattttcggaagtttgttttttcgggtttataggttagtgatgattgtggatgggaggatagggcgagagttgggggtgcgtatgtacgggagagaggttgttttatttcgagttgtagttatgataagtagagttagtagaaaatattaaggagttgatttttttaatttgttttttgttggggataggattttttttttttaagcgaggtttaggcgacggtgttcgttttttgtttattcggaggagttgtagggattgtaagatagttagagttcgaggttcgggattgggatttttatagtgtattgatttttagtcgtttgggggtaaatgtagtaaaggtaagattttttagggttagttggggtattgcgcgcggtgtagagagaaaaataagtttagtttttttagaattcggttttttgttatgttttcgttttgtagggtaagcggttagttgagtttttttgaaattgtagcggtaagtgatagttagaagttcgtttcgcgtttagggcgagggagggttcgttttggatcgttggtttttgtaggatttgcgttgcgggaggggatggcggttaaaaggagtagtcgcggggattggggatggagatagtttttaggggttttttggtgggagaggaggataggaggcgttcgtatattgatttgcggtttggatttggagggattgcggacgcgttagtttaaggagaagtcgtaagcgtacggagaggagtagagttcggtcggaagatgttcggagaatagttcggtagtttttttatttttttattaaggagttttacggtttaagagttttttcgcggttttattaggtagttagaatggtagcgggttgggtcgggttcgagttcggaaatgcgtttcggcgttttgcggttcgatagcgatacgatcggagttttgcgggaggtgggattagttttacgggttgcgagcgttcgtcgttcgttttttttttgcgagagtaggggaggggtttgttgttgtttgaaattcgtttttaatttttcgtttgtttgttttcgattattcggggttggtttttttgtttgtttattttttttattataataaaaataatcgatatttttttttagtttttttatattagcgttatttagtaattgttttttatttttttttattttacgcgttgaaggcgagcgggattgttggtattcgcgtatttggaagtttttcgagtatataagtaaattttttttaaagattttaaagtaaaaataaataacggttcgagaaattgtcgtgattttaatattattttttgaaagtaaattatatttattttttagtttttaatagcggaattgtttttagaaggatagtgtggagttttatgtgatatggttacgtttgtttattaaatttgtaaatgaaagagaatatgttttaatgtacggggtaaaatttcgggttgcgggattgtaagagcgaataaggatcggattttaatagaggaaggggggagcggtttaggggtagggaggggtagggaggggtaggaaggtttttgaggggaggttgggttgatttagttagagggagggggatttcgttttgttagggttgtagtattagtagaagttgcgtagtttcgtgaggaggacgtagttcgtggttattatatagttattagttgtagcgtttaggagaggtgtagttgcgtgtgggaaaagtaagattgtcggttttttaagtatagttgtttgagattttgtttttaggtgtcggtttgagggttttggggttgtttttttttaaagattttattggtttaaatgttgtttggaaaagataaacgagaattaggtcgcgtttttaaattttggtttcgggatttatatgaagtttttcgggggtttttattgtggtttgagttatgttgaatgtagttttattgtaaggtttaggttgtttgtaggttgttaggtttagttcgttgtattttgattagagtcggacgtttgttttttaggttttaagtttcggttgggttcgaattgttgacggagggattaatttattttagatttaatttttggttttcgaggagtttgaattaattcgtaggtcggagttattttgatcgattcgaacgtttttttatttttagtgatttagggtttatttattgcgcgttttttttaggtggtatgatgtttttgcgagtcgtttttagttttgtggcgtttggcgaattttcgtatttgagtagcggacggggcgatagggggttggtgcgttgtaaagtcgaggagttgcgtttttagtttgtcgtttttttcgagtttatttcgttatttattagttttcgtgtcgatttcgagagcggagattggtgttgtatagttttagttaatttttcgaaaataggaagcggaggttgggagtagcgggttagcgtcggagtcgtagaaaatttttcgtagttttcgagttttttagtcgtttttttcggttatcgtattttgttatagcgttatttataggagttagattagatcgcgtatttattgtagtttttgataaggttgggaatcgtttttgaaaatttatagaattttaaagttcgatatttttggtttttttttttagatttttttgtatttttaattttttattgattttaaggtttcgtattattttttattatgttttaagggaaattcgattatgtttttttacgatttatcgaaaatttattttttatgttttatcgggcggatttttttgcggtttttaggggttatttaaggatattggttgtgagttgtttttgcgttagggcgggagagttggagatagtaaagaagttttgtagggaagggtgtggggagtgatggatttatttttttttagtttattttattatttgttgagggtttacgttaaatataataattatattaaggaggtattattttagtttttattttataagagatattaaataagaatatagaagatatttggattaagcgaaattatattgttaattaatagggggaaatttgaattttattatgtttttattgttgttttttttatttttttaatttgtaggagtagtttacgttggagtttttaaagaagtttttatattttaggtgtttatattgaaagtggatatttttttatttatttttatattttagaagatagaatgtcgtttaaggtcggatttagaattcgtagtaaagaggatttgtaattttgttttttttattgttggttaagagtttacgtcgcggaggtcgtagttgattaggtgagggcgggagattgtttgttcgtttttttttggtttcggttatttagggcgtcgaggtgaggttcgtagttattcgggcggtgtataatatgttttaggagtttcgcggtcgagcggcgtatagaggagtaaggagaggatcggaagaatcgtgtttttggttgtaatttgtttttaagagtgttaagatatgttcgagatttttagcgcgtttttagagtattaatttaagtatcgaaaaaatttatttttgttttttcggggatttattttggggtatgtttgtgtgtgtttttttttaagattattatagtgggaataaattaggaggtgtcgagttgtaataaaattagaatttataattaatatagttagttgggtttaagtggttcggaagtgtacgtagtggagttagttggttttttttcgcggagttcgggttatagttgcgttttttttttttggaatgtattttggagttaggattaattttttttattttttgtaaatagcgaataaataaattattttatttataaaaaacgataacgataaagagattttagcgtattttgcgagaggtggtagttaggagaagagaaagtttaaaggttgttaggtgtaggggttatttttattgttttgggaaaatgtattttagtcgcggaattcgtttcgtggggattgggggtgcgttttcgaggcgggttcgagggttagaattgcgaaattttaagttagtgtttttaggtttcggataaaaattgcgatttatacgaggattttattgttcgtattttggcggggattacgaaagttttataggttagtaggaattttgcggttagcgggggtatttttgtaattttttgcgtagggattttacgttttaggtttttttattggttggggttggttttttcgggaattgggtaggttttaataggtttttttatttgtaggttgtttgttttaagaggcggatttgtggggtttagggcgaattttttttttttttttttgttagttagtgttttttttgtttaaaaattttatttttattaggattaacgaaagagttgattttttattttttttatagcggttgtggttttttagataagttgcgtgtttgagttattgggagaatagagtataattatttttttatggatacgattggaaggtagttttaggaaaattgttaaaggatttaataatgtttttaatggatatatagaggttaaggaagagaaatgtaaaaatgaaataaatataattttaaaagtgtttaattttttaataagttaggaggggtaaaatatagtattatttttgtagagtaaattaattttgttagtaggtataaattgttgtgtttttttttaacgagagagggggggaaaaggttgtttgtatatgatttatattttttattaataaaatgtttttaaattaatatgaattagtttattttttttggtgggggcgggaattaagtaagtgttgttggttttttttaatagatgtattgttttttgtatagaggtaaaaaataatttgtaaagtgttgtttatttagtgaagttatttatatatttttaaattttaaagatgtttaagtttataatgttattgcgtaatttattttggtagtgtatttaataaaaattatattattggtaggatatttaataaaaattagattaattagtaaggaagggtatagtagataaaaaggataaagaaattttttgagtagaaaatttagaaaaataaagaagggtttttagataatattaatttttcgtgtattgttttaatttttatagttttgtttattgtagtttttacgtattaaagtgttatagtttgggttttgtttttatgttatatttagattgtaaatttaatggttgtaggggggagaggaaggattgtaaaattagagattagtattagaaatgttggattagtgttttatgtatgatgtagttatattattgaggttattatttttgttagatttttagggtggatatagaggattggggaagaaggttagttttattttttgtaggattaaaatgttagtttaatatattggttgattagtgagttattttttagaaggatagaaaattaaggttatggttataggggatttttgaaaagttttatattatttttttgtaggattagaggtgtgaatttgatgttttggtaagttgataatatagatttttttagtagtttttattgtttgagtgatttatatttaatttttttgggattgagttttgttttgttatatgtttttatttttggagatattttttttattaggaaaagaaataatgattttattattttatgtaaaaaatttttataatgttagtttaaggttaaaaattaaatttttgaaagttagaatatagaaaagttaaaatttttttagtttgtttaaattattttgttttttaggttgtataatgtatggtatatttataagtttttttagtaaagttaataattagttttagtaattaggtattgttgttgttgtgttttaaaggggaaatgttggagtattatttgattgggtagattttttatttgtagtttgaatgttttatgttagtagattttagtatttttttgttagatgaaagtattatattgtatgtattggtaaatggatttaaaatttaaagaaagtaaattaatttataggtaattaaaagtaatttaaaataagagagagatatcgtaaatatttcgaagattttttaggtatttaaaattttttaaatttagttgtagtattttagattagtgttatatatttttttaattttgatataaaatgaagttttttaatggtaattgatgtaagtaggtatattttttttaatttttttttaatttttattttagaatttaatatttatttatttagtttttttaagaggaaaaaatatagttagtagaaagatgtgttatttaaattgtattttgaaaatttagatatagtttatataaggattataatttttagaaaaagttttttttatttttttttttaattttaaagtagttaaaagtatgagtttttttttataattagatttatttataatattttggttgtgaaataaaattatttaagattttttgttttttttatattaaagcgtatatatatatatatatatatatatatatatatatagaaaatagagggttaatttggtagagttgtgtgtaagttgagttatggtttttggttataatatgtatatgatttgtgtgttttattatgtaattgttaaggtatatgagggttttgggggataaaggtattaggtatataggagatattattatttttattagagtaattagttttatggagaaatatatatttttagggtaaaatatatattgagttttgtaaaaggaatgaataatatatatttggatattattatataaaagttgtatttttttttttttataggaatattttttgtgttaataaaaatgatgaaggtaaagttaggtagtttggacgtgttattagaatttaaggtataatttgggattttataattttattatttagttgtttaaaaaaaattttaaatatatattttaaagtttttttgaagatatgttttttattatatagttaagttttaattaattagataatttaggaaagtatttgaaggaggatatggtgtttcgtgaatattttttaatgtttttgaataaaatagaatataagaaaaggaagtgtgtgtatgatgtattgttttttatgattttttgatatgaaaaatattttagaaattaatttaggttatttttatgttttttttagaatatagtataagaggggtagtttagaaaggtgaatttaaatggatgtttttttgataattataattttttggtaaatataatatttaggtagagtagaatggggattattatatattattgtgataatagtgaaaattaagatagagagtttgaatagttggtttttgggtgaagaatagtattttgagaaggaagatgaaaaggggagagggaattgtttttgttaaagattaaagagaagatatttttttttttttattttattttatttttattattttaggtatttagggaaatttaaatgaatgttgggattaatagtagagggatataaatattgtaaattaaatttattgttatttttgttataataaatattgttaataagtttgtatatatatgtgtgttataatatatttaattaatttatttataagaaaaatttgttaatttatttttgaagataatttatagtatgagatttttagaaatatgttaagtttaaaggattgaatttagattttttatttgttttttaagtttgttaaagatatgtgtttagtttatgggttgtattgtaggtttataggtttttttttttttgttttttttggaagttagtattgatttggggaaatataaagtttttattttgatgtatattattatttgtgtttgagaatttggtattaagaaacggtaatgaaaattattgtaaattgtattagttaattagagaaagttatggatattaggagagtttgttttttatagtattttatttaatatttttttttttttttagttttatttttatttttttttttgagattttttttttttttttttttttttttttttttttttttttttttttttttttttttttttttttttttttttttttttttttttattttttttatatatatatattttgtatttatatattttttagaagaaagtagtattttatataagattttggtttttaaaatgttgtttttttattaaaattttatgaaatatttgaaagtatattaggaaattaagtataatattattaagaagagttttagcgaggttttaaagagttagttttttttatttagatttttaaatttattataaatgtatatatgtttggattaattttggagtttatattttaaataattcgtgaaaaagtatatttagatttttatatgttttggagaaattattatgtagttaatataaagttaatttttgttatttgtatttgtttataaatttttaaaagtaggtagattggttttagttatatagtattaaggaaatacgagttttagttaatttaaagtggagtttggagcgatgagaagttatttaaagttattagtgttttgtggttgttttttgatttatggtttaagtttatttatatagttggattagaaatgatgattttgataaattttagtttattttttggagtttttttggaatattagtttgggttattttttgtagtatagttgtacgtgttaattttagggtagttgtttttttttaagtttatgattgagggtggtaagaggtagtgattagttatttaattttttaatagttgtaaatattaattgaatattttgaataattttttaggttatatgataatatgtggttatttgttttttagatttttattgtatagttcggggagtaaatattttttaataattgttaaatatattttataaattttttaaagaggaaaaagtttttatttaaaattaaatataggttatgtgttaaaaatgggtagttggaattaaaatatagttgttattattttttttataataatatttatatattattaatttttttgtaataacggaatattaaagaataaaatgtaaattttattgttttatttgtagggatgaaggttagagtgttaaattgtagattttggatttttaataatgggtcgttgtatttaatttttttaattttttttttttatttataagaaggaataaaataaaatgttttgtggaagtttatattgaaatgaggttaggtaaattaatgattgtttggtattttatgataagttttataattttggagttgttataatttttaaacgattattaataaagttttattgtaaaagggtcgttatgtgtttgaatgtttttgtatatagtaaagttatgttgttttattgtcgtagtttattagtttttttttattttagttataaagttttttttttttttattggaggttgaaaagttttcgggtttgtttttttttattaagttggtaatgtgggaataatatagaaattaaattatatgattaaatgatcgtatataattaaatttttaagaatatgtaataagattgttttttaataattataaatttggattttaaatgggttttatttaataaaataaatgatagtgggcggcgggtgggaaaggaggaagttagatgagagttttttttagaaatttgtgtttgaatgttagataagatttattagtttattcgatatatttagagggttgttattaaataattaggtgtttagggatcgataatggttttaagataaaataacgaattgttaaagattttttgagttgattcgaggattttaaagatttaagaggtttcgtattgcgttttaatttgaatttttttacggagggaagggttgggttatagtttatgtttgttcgattgttgtttaatatattttttaaacgttttttaaagttaaattaagaattttaagtgtttattttacggtattagttgttaggtttaggttcgggttcgtttattttttgtttattgtcgaatgttatgtggaaatgaagtcgagaataatgttttgcgatttagatgaagagaatagtaagaaaggtagtatgaaacgaagtttttattgacgcgttttttagataggtatttcgtaggcgagggttgtgatttagggagagagtgcgggagtgttagtagagcggcgggagcggaaggagaggttggacgaaagttggaaaattattttatttcgggatttgagtgcgagagttcgtttcggagtcggtaagtttttagggttagaaggttttagttttaaagttttttgtttcggtttaggtaggttttttatttttaatttttttcgatttgtttggttgttttcggggaagggattggtaaatatcgttttttttcggattttttgaaatttttattagcgcgttgaattcgtttttttttacgttcggcgtttcgtattttgcgtttgcgtttattgcgcgttatttttttttcggtcgagattattagagttttagattcgggatttgcggagggaataggatttgagtttttgttggattttgtaatttggttgcggagagcgcgtagttataagcgtcgttttttatttgagggtttcgcgagagttggtttagtttcgcgggttttcgttagttttcgttagttttcgttagtttcggtcggttttacgttaagttcgtagtaggcgggaaatttcgtaggttttttcggatttacgaattgtttatttttatttttaaagagtttagatttgaaggtgtttttatggtgcgtggtcgtaatttcggagtggaatgggtggggggtttttatggcgaaggagacgtcgtgggcgaatcggtttttagttcgttttttatgttttataggttattagtcgagtttttatttcgggcgtttttatgaggtattaagagtagttacggtttagggaagggtttgggtttttattgttggagcgggttttagtcgagggcgcgtaggtgtcggggtttttagtaattttcgtatgcgcggaaagtcgtaaacggggttttgaggtcggcgttaggtataaggattatttcgcgttacgggttacggtttagagcgtttacgaagttcggttgttaggtttaggtcgcggtcgggcgggatttattcgttttttacggtgttggcgcggcgggagtcgggttggttaaggcgggaggtcggtattgttacgggttgtggcgttttttttcgaagatatttcgtcggaagtgcggttttcgtttggtaggcgttgagatttttcggttgtagcgcgaaggtttcggttcgcgtaattttttataataacgtcgcgaaatgtttttagaaatgtttgtgtggtatggtgtttgagttaatggtcggtattcgttttttttaagtgcggaaaagaggattttagtttttcgggatgagttacgtatttatatacgtacgtcggtttttgtgttttcgttaggggaagcgtagaaaggcggggatttttcgggacgtaattgtttagtattatttattaagagaagttatttttttttcgggattatagaattttttttttacgtttttaagtttttagtaagaagtgggagaggacgtgtgtggttttttagaagtaggttttaagttgtttcgggggtaagttttttggaaggaattttgttttgttgatttaatttgagtagggttattttggttgcggttatttttatttcggttttagggacgaatttagtcgttt

SEQ ID NO: 37 - DNA, 21430 bp, Artificial Sequence
  chemically treated genomic DNA (Homo sapiens)
cggttgggtttatttatttttttagatggggaaattgaggaggtaagaatttgtttggagttttattgtttgagttttagggttgtgtttatggcggggtatttagggggaaggggagggtttttggtacgtgtcgagtttttacggacgttcggtttttggtttttgaatttttttgggcgtttcggattttttgagttattttgtagataatgtaaggtagcggttaatagacgagtttcgtagtagttgcgtaggcggcgagtatatgtgagaagtttgtgaaaggcgattagagaaagggagaggaaggtaagttaggcggttgcgaatatttggttaggtagtttcgttagttgtttcgttgcgcgatggtattttgagttcgggtttttttatcggggttatattttattttattttttttgttttttttttaattttttaatgtggggtttgggaatgaaggtgggtgggggtagttgttggtttttttaagtgtaatttgtgttcggaagtatgtttggagtttggttagttttcggaagtaagaagagaagtaaaatttgtttattttattttttcggattttgggtttgggagatgggataattagtgttagtttaggatgttagttaggattaatttgagttttagaattagataaattaaggtttttttttttatgttattattgtttaattgtgtggttttgggtaatttatttagtttttttatgtttttttttttttatttgtaaaatggggataatgatattaattttataggtttgatttggagatttagtgtataatatttttaaagtatttagtttagagttttgtatataggaattattttataaatggttttttttgttattattattatggatatttttttggttagagtttattaatttaatatgaattatattaagtttttaatgttgtttggtttgtagatatgggtattggaaatatagatagttttttaaggagtagagattataaaatattacgtttttattaagagataataagggaagatgtaaaagatattggaagtttaaagaaggaaaattttttttgagtttttatgaagtttatataattagggtaggattttaaaataataataataataataataataataataataatttaagtgataagggtatagattaagttttttaagtttagagttttagattttttgtatttaaaattatggatgtttattaaaaagtacgttagtttttgaggttagtatttttgggtgtgggtttgtggtgttgtattttaagaggttgtagatgatttttatatatattaaaattgagaatcgttggtatataggaaaatgtatttgtttttaggtttttattttttttgtatttttataaggttagtttttttggaggatatggtgttttgtgttttgattttattttatatgtggtaaatttatgtttttattagattttgagtttttgaagtagtgttttttgtatttttaaggttttttataagattttgttgttagtaggtatttggaaatgtttatcgaatggggaaaattttttttttaatgttatttgtataaatgtttatatagtttttatatggatttttatatattttgtttggtttataaatggtatgagtgtgtgtgtgtgtgtgtgtgtgtgtgtgtgtgtgtgtgattgtaatttaatgttatggtggtgggggggggggtgggtaagtgttttttagtttattatagttttaatttttttttttatttatttagataaagttgtttaattttattttattagttttgtattttatagaatttaagtttataaattttggaaagtatagaggttgttataaattgtcgtttaaggttgtttttttaattgttttttttatggttttttttttttttttttttttagtttttagtttgttatttttaaggtttttttaaaaagattggtttttaaggatgggtgttgttttatcgttggttgtttagaattgttagtagatttttttagaggggaagatgggaaaaattttaaaatatatgggattagatataggtgtgttttttgatgtgtgattttaatgtttggggatgttggagtaggggttggtaaggtgaaggttaatattggaggtatgtgaggattagttagttttgttttgtttttgatttatgtttgatttttatgttggttagtattttttagatttttgagaggatagagtagaaaaagagaatggatatgaatttttttttttttagtttttaggggtttagttttatagataattagggtattatggaatgattatgggttttagggtattatgggattaggtaaaatatagattagtgtatttttgtgttttattttttttttttttttgggtttttagtattgggaagaaaataaagattggttttaaattttagtgagtgataaaatattgtatttagttttggggagttgagtgtttttggagataaatttttgatatgtttaaagtatgttttatttaaattaattagaatgatagttttgttaaagttggaagttttgttaaagtttagtaattattttatatagtttattttttgtaggtaaattgaggtttagttagggttatttatatttcgtgttagaatgtagttttaaatttagtttttttgtagtttatagttttgatgtgtattttgtatttttagaattttgttatttttatgttttgtgttttgtttatgaatttattttttttttattgtttggtaagtttagagttaattttttgaagtgaatattagattggtgattttttgagtgttaggatggattttgatttatatttgtgttttagtttttggtatggggtttggtataatgtagatgttgggtgaatggagagtaaggatttatagtatgtacgtgtagataaatcgggttttaggaggatgatttggtttatttttatttttatatgttttttttttaagttgaggaagaagagaggaatatgtatttaatgatattaatgcgttaggtattgtgttatgtgtttattttagtgtattttttataataattaatgggaaataaatgattatttttattttatagatggggatatcgtagtatagagaagttgagaatatttcgtggttttagttagtaagaggtagaggcgtattttgaatttgaggttagggtttgagcgttatggtattaggttgtgagggagtttattgagtattaatttcgtggtttaatgtttttttttttattttaattttgaacgtttttattagaatttaaggaggtagatagtagtgtaattttatttaagagtcgtcgaaatcgaggtttagagggttttagcgaaagggttgcgtttggttttaggtatttgggttgagttttttttttattatcgtagggcgggaattagcggagggggttggttcggatggggagaaaagtaattggagggcgtcgaggggaagagggagttcggatttgttagggcgtttttttggattaagggatgtttttttaaattatattattttatttcgtttagattttgggaaattcggtacgtatatattttgtataataataggtagggtgaggtttttaagtttcgaagatcgtttttttagcggaggtagtggttttgacgagggggtatagttgtacgcgcggggttttttttcgaatcggagtgtagcgtagtcgaggtttaggattttttatttattatttacgatgtttattagagcggggtaagggagaggaaagaagagggaagtagagagaaaaagaggttaggggaggtggaggcgggtagtgttaatttcgagagtttttaagtttcgaaattttgagaaggaagattaagaggttaaggcgtttgggaagtagtaggtcgttagtaaatatttgtaagatggatggataattgggtgagtgagtgaatgggttaattattagtttttttgatttttgttttttttatttgtaaaacgggataatattatttattttatacggtgggtatgagaattttatgggtaaattttaaattgtttagtatatattaggaatttttaaacggtagttgttgttacgaggaatgggtttgtaagttttggttgtttagtagaaatgtattgaaggatttttaggtttggagggttattttgaatagtcgttattttaaaaaaaatattttataagtttttttagacgggagggttggaggaagagtgggttaagttatattttttaaatgaaagaaagaaaggtaagcgtggggaggaagttatttcggattgagaaggtagttattgtttttatttttatttcggagcgcggttgagggaggtggggtaggggttatttgggtttcgttttggtagttttttattttttttagggttcgtttgggcgtttggaggcgttttttcgttgcgtcgcgggatcggattttggtggatagtttgggcgtgaggttaggagcgttttggaaatgggtagtttggcggtagtcgggtcgacggagtgtgtgtgtgtgtgtgtgtgtgtgtgtgtgtgtgtgtgtgtggtggagaggggaagttggagtagggttaattttttgttttagtttagtttagggttatttttttatttaggtagttcgagttgggataggacggagaggttgggatttttggggtggtatgggggaagggaagtttacgaagaagaaagaatcggaaaggtttggcgggttggagttagcggggcggggcggattgggagaggttaggttaggttcgggtataaaggttgtggagggggcggtcgtcgcgggcgtagaaaggcgcgtcgttagttgttgtttttttttatttttcgggtcgtttttgcgagttttcggcgcgtgagtacgtttgcgcgcgttcgggttttttttggtaggttgtttgtaagatgagtgaagaagtaggtgggggagaggggaggtagcgagcgagagggcgaggggagcgcgggcgttgagtagcgtttatttggagagcggtaagtaagttagataagtttgattttatgttattcgttgttattttgttaggagcgcgaagatgatggttatgaattttaagtagtttttcggtatgtattcggtgttgtaagaatttaaattttttagtttgtattttggtttcgaggttatgcgtcgagtttgttttttagtttcgtaggtacgtagtggagtataattatcgttttaaggtatattttttgataggtattagttttatgttttttttatgtcgtttagaataatcgtcgttgtttgaatttttttttttgtttttttcgcgttttttttcggcgcgtttttttttttatttatgtttttgatttatacgtttgttttagtagagtcgttgttttcgtattaatttttatgatttgggttttgaggagaggtatttcggttgtttgaaaatgtgttttaattttgtgttgatagtattttttattgatcgtgttgtgcgttttttcgtttgtagttgtagggtaatatatttggaagttttgatgagagtttgttggtacgcgtcgaagttttggcggcggtggatatcgttttttacggtaagaattattcgtttaagttcgacgttatttattatattatgagtagcgtgttttgtacgtttatttcgtttatcgtgtttattttttatttagttgcgtttattttatatttttattacgtcgtgtattagggtttcgaaggcgatttgttggagtatatttcgtttacgttgagtgtgagcggtttgggcgtttcggaatattcggtgatgttcgtatagatttatttatattatttgggcgttatgggttatttgtattaggttatgggtatgagttattcgtatatcgtggttttttatagcgttatgtttgtatgttttagcgacgtggagttagattcgcgcgagttggaagttttcgtcgagcgttttaagtagcggcgtattaagttgggggtgatttaggcggacgtgggcgcggttttggttaattttaagattttcggcgtgggttcgttgagttaaagtattatttgtaggttcgagttttttattttttcgtataataatatgatcgtttttaagtcggtgttttaggtttggttggaggaggtcgaggtcgtttatcgagagaagaatagtaagttagagttttttaacggtagcgaacggaagcgtaaacgtacgtttatcgcggcgtcggagaagcgtttattcgaggtttatttcgttatttagttacgttttttatttgagaagatcgcggttatcgttgagaaattggattttaaaaagaacgtggtgagagtttggttttgtaattagagatagaaatagaaacgaatgaagtattcggttgtttattgattgcggtagggcgtagcgtcgggagtcgggagagtttagtgtttatttttttcgggttcgggggatggttatcgggaattttaaggcgttttttaggtaggttaggttttttttttcgaagttatagattttttttttttgtttcgtttggttgttttcggtttttttttttttttttttttatttttattaaaaaaattttggcgttgggaaaatattgtagaagggcgggtttgagtgtatttgtgttgttcgtggtgttgaaatttgttttcgcgtaggggtcgtacgattttagagtaggagttttaaagtagaggatagttaattggtttaatcgttcgaagttagggtgaaaatgttattttgttaagcgcgattaggtaaagggtgaagggataaaaaggaagtgattaataataatataaagtttaggatatttaagggggatataaatatgtattggagatttattagagtatataaaatatatgtatgtttttaaaggatagttttatatttttttttttgtttaaattttatttattttattttttggtttggcgtaaatttttataaggtagtatgaagattaggtttagggaaagtatgtagggagttgcgggttttaagttgttattttttcgtggtaagtagggttttaaaataggtgggtttagtttggcgattgaaaattttgggatcgtttggttgtttgtaattagttgttagtattagttttggttattttttattatttattggtgtttgaggggtaattattgtttgttggagagcgggagtttgtagtatttataatcgttgaggattttttgattttagttcgttgtttttgttagattgttagtttagcgtgtagtcggttgttggaaaacgattgtaatttttttgtattatatgtaagtttttttaatacgtttaatttttttgtatttttgttattattgttgttgttaatatcgtttattattattatttatttaattttgtttttttttattttttttatgtgggtgtttttcggtggaagtttatttatagttttgtgagggaagaggagtgggattatgggtttgaattttttttattttgtttttttagtttaaattttattttattttttcgttgttttatgtagtttgtgtgttgttgtgtgatttttggttttattttttgaatagatataaataaaatattaagtttttttttttttttattttttgaattaatttttaaaataaatgttttattttttaattcgaattaaagtggttttatttttttttagaggttaaggggtattagttttgaaaaggatttaaaaaggagaattttaaagggttgggttgttagtttttgttgtttagtttttagttattttttttttttattttttttttatggtagatttatttggagtttttcgtgggagattttgcggtttgtgtttgaatttgaggttttaaggtatttttttttatgtttttttgtttgttattatgagattttgtttaatttgatttagttagtaaattttgaagtcggattaatagaaattcgagtttttaatgtttttgtttattggtagaattattttgaggttaattttttaatttttttaagttttttttaataagattgtttgtttgtagaatgaagggattaacgtttattttataaggttattgttaggattaggtgagattgtttatttaagacgttaattagtgtttgggttttgtaggtaataaattattttaaaagatttaaagggtttgaaaggaggtgaaataatagaggtaaagagggagaaaagtgttcgttgggatattttagtgggatttatttagagttttaaatttatttgaaatttttatttaggttgttatttattttggggtttatttcggtttttttgtgggggtattgttataattgttgtaaagcgtttagtatagtgttttgtatatagtaggtgttttatagacgttagttttttgttttttttacgttttttttttttatttgcgagttgtagaaacgtttttttgatttaaaatttaatgttttaagtttaggagttatttgtatatttttttgtttcgtttttaaagagttgcgggttattaaattacggggtcgaaattcggagtagagtgggtttgtttttcgcgtagtgcgatattttttatcgtataagttaatttgcggattttttttagttttttgggttttagttttttattttcgttttgtataatagttttagcgatttttttatttttttttttatcgggtgttttttaataataaatgtttttatgttattatattatattgtgggttttgaaaatttaaaatacggttgatgtaatattaattgtttatagtggtataaaatatagggtaggagtttagtcgggttgtagaggagataatcgtgagcgtttcgcgtcgaagcgaagcgttttagaaggacgcgtttttgcgggttgtaaggttttttgtaggtaagaagagttttcgtatgttcgggttttggagagaatcggaaatttgtttttatttttttttcgaaaagttttttgtcgttatttatttagttttttttttttttttaattgataattgtaaaagtttgggagatttttacggagaggatgagaggagttgttttttgagcgtaaggtttgttttaagacggtttagtagtattaggtttagttttcgagttatgtttttgagtttagttttttttaggcgtttgagacggtgatgcgtaggagtatttttattagtttttacgtgtaggtcggagttgtagttcggttagcgaagcgttttattttttttttttttttgagtgcgtcggaacggcgtcgtcgttttatttttcggtttgttttaggaagtaattggagatgtggtttttttaggattgtgtagtcgtttttgttattcgtttggcggaggtatagatttttcgggggaggggaggtggtattagtaggtttggggtttatataaggttagtatgtattcgaatcgtgtgattttggataagttatatcgtttttttaagtttttgttgttagttgtaaaatttttttaaatttattttgaagagtaattgagggtgttttttaagattatttggagtaggtttttatttttttaattttgttagtttgtaatacgtacggtttaagatttagttgagagtttttttaatttgtattaagagaaagtgaagttagtatttgggggtgtttgtatggaaatttgtatcgggttttcggagggtgggattttgagaattatttggttggaataggggttttatttagaatgagttaggtatatatattttagtatgattaaagttttggtaggtagaatttggtggtaggagttttgggtttttgaacggtgttatttttggttagcgattttttttttgtgtgtttaagtagttttagttttgtttattattttatgtttagtattttgtttaaggtttggtttagagtggtagatattagatgtttgttgaatgaatgaattaggtttttgttttgtaaaatgaaagtattttttttagtcgaattttttttggatttaagggattgtagggaggaatagagttattagggataggtaagtttttttgggaatggggatcggggtaaggcggtggtttgtattataggtttttatttaaggtagttagtgttttttttgtttaaatagaagagattgtgttttattttttggtggttatgggtatataggggatgttttgtgatatggtttttggaatttagaggaagagttagggaggggggattagggagtgatcgttgttttgtttagtgtgtttgacgtttgagttttagtttttttattgtttttttgagatggaaatagtttcggttttggaatggatatatttggggtggaataattgttttattttttatttaagtgattttattgttttgatttttagtgtttttatttgtaaaattggaaaaattggaaaaaagatttttttaggattgttttgatgattaaatgagattacgtaaggttagggtttgatatatagtaggtattaatagatatttcgttgttttaaaatattttttgtatttagaaaagtgaaggtattgttgtggggtaagtttagggtttggagttaagtggaattaatattttttttttgtgagttatagtttggttagggtagtagtgtttattagttttcggagtggttgttacgggtaagacggaagtttaaaagaaatcgttttgtatattgtgcgttttagttacgtaaggaacgaagtattttttttttgggagtgtttggtgcgaatatatagtttttattgagaagtttggtttcggttagcggttttaggagttcggaattttttttttggcggaatttcgggtattatttagttttttcgaaggttttagatttcgcgttgttttttttttcgaggaggggcggggcgttagagggtaaaggagaagtaagggttttggatttttttttttttttagcgaatatttttttttcgttttgtttttattttttggtttcggcgttagaatgtttgagtcgaaggggtagaacgtttaaaagtcgtgtttgtttatttatttatttatttatttatttttattttttaaatcgaagaaggtagtgaggtttagagagtaggacggatttagttggttttttttatttaaaatagtttttttttaattacgttattatatcgttcgttttattttttttttagtttttaagattgtttgatagtatttatttagtttatttttgtttttttgaatttaacgtagggtttcgtatagaataagcgttttataaatgtttgttggataaatgattagtgatgatatttaaaacgtatggcgggatttttttatgcgaggtattgttttaagcgttttagcgtattcgtttgttaatttttaaataatattatgagtaggtataatttttaattttattttatagatgagaatatggaggtatggagagtttatgtaatttgtttaggataagttatgaatatagttatttagtggagagatttggtaaaaattcggtgtttttgtttttttcgtttttaagtgagattatttttggttggggtggggaagcggatcgtttgggagtgaaggaggagtaggtgagttcgatttggtattagattaggtagcgcgagtagaggaggtggtgggagtcgagaacgttcgttgttttcgtcgggtttcggagtttttacgtttttgtgtttcgcgcgttattcgcgtttttcgttttgtttgtgtgcgtttgttcgcgtgttttttatttagttttttttagtttttttttagtttcgcgggcgcgaaattttggtttttatgtgtcggagcgagggggttcgcgttttcgggcgcgcgtagagtcgttttttttttttttttttttttcgtagagcggcgggagttttcgcggtaatttcgtttcggcgggtagacggagttagcgaggatttcggcggataaattagtttttttttcgatcgttttttttcgattaagttaggttttttttgttttttcgacggcgttttcgtattagcgcgatttttagggtttttcggttgggttagggttcgttcgtttttttcggcgttttcggataggggttttttttcggttgcgtttcggtttgaggagttttttggatcgcgggaggggcgattgtcgggttcgcgcggtttagaattttttttacgcgttgtttatatttttttttgtaaattgttagatttttgtttttttttttagtttagttttgcgtagttttgtttgttattggaggtaaattgggatagaaattgcgttcgttttttttttatagattgtatatgtaatttaatatttaaaagattttgagttttaggattatatatatatatatatatatatatatatatatatatatatatatataaatttaagtgtttattttgggaaaagttagatttttgttggatttttttatagatatttagtatttaatattatttttattttgaattaaatggggtgggaggtattatcgtaattttattggggtttttggtcgaattttttttttaattttattattttttttttttttattttttttttcgtttttttttaaaatatatattagttttgttttaaattttaatattcgtgtttgtgatagagttttttttaaggtttgaggtttagttaggttgtttattttttggtagatatagttaatgtttagtttttataaattaagattataaaaagtttatttttatatgtatttaatttttattaaatttaaattaattgtataaatttttttaggttatttagagttgttttttgggttgggatttgattaattagttattaggtattttattagttggggtttaagttgttttatataaatgttttttgttaatttgtttgtaattgaataaataaaaagggtataattattagtatagaggattaaaataaggagaggttaattttatttaaatatttttaaaatgttttaatttaataattatttaataataataattagaaggtatttatatattagttattttaaaagtttttgattatgttaaggaaagttttgggttgagatataattaagtgtgtatatttaaagtttgttattttgatagtagtattttttttttttggagttttagtttttttatttgtaaagttagttggttagaggtgatttttttttttgattttatatagatgtattttatgtatggttaaattaatttatgtatgttatttaaaaatggaataatatagaagggtaatttgattattttttatttttaattatttttagttgttttttttggtagtgaattgtatgtttaaataatgtatttttggtattatttttttttttaaaattcgaggtttgtttattaatattttaattaaataatatatgatttaaatttaaaagaattaaaagatttgttatgaaaagtttttttttttttttgatttaagttatttagttttttttgttgaaggtaaataatattgttagttttttatgtatattttagagatattttattggttgttattttttgatttgttatttttagttattttgttttaattttttgttatgatattagaaaattagggatataataattttgaatattttttttatattagggattataggaagttttatataaaattaataattaaaaaaatgaatttagtgggtagttgaaaattttgattttttttttttgtttttttgagatagagttttgtttttgttgtttaggttagagtgtagtggtgcgattttggtttattgtaatttttattttttgggtttaagtgatttttttgttttagttttttgagtagttgggattataggtgtacgttattatgtttagttaatttttcgtatttttagtagagatggcgttttattatgttggttaggttggtttggaatttttgattttaggtgatttatttgtttcggttttttaaagtgtagggagttatcgtgtttagttaaattttgattttttttaattaataattaatttggaggtgtagacgttataatgtataaaaattgtttatttataaagagggtttatatgttgatttgagttttattttatttttttttgaatagaatttaaagtagtttatttgttattgttatggaattagatattatatttatagtggaggtatttttatttattggatgttttagtgtatatggtatttagtttaattatatttttttaaaaatttttttgtttttttatttttattaagtaagtttatttttttagtgaggggagtttttttttggtgtatatagttatgatagggttggggaaaatattgatgatattatttaataatttatatttaggtggttgggcgaggtggtatatgtttgtaattttagtattttgggaggtcgaggtaggcggattatgaggttaggagtttgagattagtttggttaatatggtgaaatttcgtttttattaaaattataaaaaatttagttgggcgtggtggtaggcgtttgtgattttagttatttaggaggttgaggtaggagtattatttgaatacgggaggcggaggttgtagtgagttgagaatgcgttattgtattttagtttaggtgatagagtaagattttattttaaaaataaaaataaaaataaaaaaataaataatttattaagggttgggattgagtattagattttagattgtagaaattttagttgagtatttacgtgggagggagtcgagggtttcggaatttttgatagaattttaaggtggtgattttgatttattgttgggagagatataaggagttattgtttttgggtttgggttgatttgttttgagttttatatatttttttagtgaattttttttgtagtaaaaaatatgggttggaagagagtgagtttagggaaatagaattatgtcggatgagaatataaatatataggtttgttggtgtagtgagaaagaatatagaatatatataaagagatttgagttttaggttttattttgttttgtttgattttggtaagtttatttattttttagtggtttagtttttttaattttaatttgaagaaatcgaattagatagtttagtagtttaaagttggtgaggatttatggaattttttgaaaatttgaagaaaattgtgtttttaatttagaaataaatgtatttttgtgtatttaaaatttttgttaatttgtagaagttatggattttttgatttaatttataaatttttgggttttaggttaggagtttttaaaattaggtaaattaaagggttttttttatgtgattatttaaatttagggttaaatatttataagtattgaattagtttagtaaatagggaagaattttattgaaggtaaaaataaagtgttaattagatgatgagttaattgttaataaggattttagatggttttgataaaattattttttagattaatagttttcgaagagatagtatggtggagtgaaaaaagtattatattaggggttataagttaggttaaaatttttttaatcggttttgttaataggtagaattgagattttgagttgggatttttttgttttagtttttttttttttaatggtaaaatgagagggttgaattagacgatttttgaggttgttagttgtagtattatgtgagttaatgagtatagatattgggatgttttatgtttatatttattttggtttattttatttttttattttgtttgtgaaaagatagttgtataatttaagtagagttgggagaagggttattaagtatgttattttttgggtttttagaatttaggtttttaagattattggtagaaacgagattttttaaattattacgcgttattgaaaaaataaaaatatttatagtttgtaagtttaaaaataaatggtagggtgggtaggtgaggtggggtaaaattaaaatattttgttagattaaatagttttggtttagttaagttggtttattagtaggtttagagagatttagttttattagtaggtttgggggtagagggattgtggtttgttgtgggttgggtaaagtagtatttaaatttgttttagttttggttggagtttatagataagaaaatgttggttgggcgtggtggtttacgtttgtaattttagtattttgggaggtcgaggtaggtagatttttttaggttaagagtttgagattagtttggttaatatggtgaaattttgtttttattaaaaaatataaaaattagttgggcgtggtggtatgtgtttgtagttttagttatttaggaggttgaggtaggagaattgtttgagttcgggaggcggaggttgtagtgagttgagattttgttattgtattttagtataggtgatagagtgagaatttattttaaaaaaaaaaaaaaaaaattaaaaaaaaaaaaagttaattagattatttgttttttgtttttagatttttatttttttatttttttgatttgtgttaatatttgtagttgtgagtttatttagtttttggggtttgagttattggttagattgtttaggtaaaatgattaaaatttggattatttttaatttttttatttttaattttttagaatttttgtttgttttatgttttttattttttagttgtttttgtttttggtattttattatcgtttatggttttgtgtaggatggtttaattttttttattaattgtgttaggttaatgagggaagatttgtattttttggattgtaatagtagggtttttttattataagaggggttttaataatattgatttaaatattttatgttattatcgttagacgtatgaaattttagtatgtgagttgggaagagtttttagagatttttttattggaaaatatgatattgtagttttagggatttaggtatttatattttttataatttttttgtaaaaaattatgattttttgtttagagtgaggaaaagtttttttataagtattgtttttttaattaaagtgttttatattggagtttgggtatatattttgaaatataaattttatgttaatttttattttattaaaggtggtatatattttgtattttatgttaataatatatttttgattgttttgttaaatatggacgtgagtttgatagtttggattgttgtaataaatagtataagtaaggtggtttaaataacggtttattttttatagttttggaggttgttaagttaaagattaaggtggttatatattcgatgtttggtaagggttttttttttggtttatagatggttatttttttattgtgtttttacgtggttaagagaaggagagattattttttttatgttttttttttaaagggtacgaatataatttatgagagtttatttttatgatttaattattttttataggttttaattataaatattattatattggggattggagttttaatatattaattttgggggtatataaatatttagtttacgagtttgtgtgtgtgtatatttatatattattgtgtgttatggagtagattgatgtagtatttagaatttttggttataatcgtagttttgtatattgatatgtggtttataagaataagtagtttaatttggaaataaattttaatgtaatagttttgttgtagggtaaagatgataattaaaaggaatttagttaatatgtggtaaataataataaaacgatttttttattaattattttaggagaatagttatttaataaatatttgaatttgagttagtgaatgagttgtttttgtttattattttttttatgatattttgttttttaaaaggcgaaggaaagaaatgaattttattttattttttttttggagataggattttattttgttttttaggttggggtgttgtggtatgattgtagtttattgtagtttttagaagagttgagtatttttaaagatttttatttgatttaatataaaataaatagaatgattaaaatgattatgaggtcgattatgtttgtaattttagtattttgggaggttggggcgggtgaattatttggggttaggagtttaagattagtttggttaatagggcgaaatttagtttttattaaaaatataaaaattagttaggtatggtggtgggcgtttgtaatttttgtagtgtatagtttattgtagttttaagtttttggttttaagtgatttttttattttgttttttttacgtgttgagattataggtgtgagttatcgtaatttgttaagaaaggagttttaaaaggtatgtagtgtttatatatttaaaatatttttttttttaaaatgttttatatatttatgtaaagtgtatgtattatattatatattttataaattaggtattaggaagttaaataatttgttaagttaaataacgaataaatgttagaatttaggagttaaaattagaatggtttgttttgagagtggtgttaagtttatttttgtagaagaaaatggatttgtgtttttaaggtcgaaatttgaagggtttttatgtgaaagaaggtttatttttgttttatggggttttaggggtgtagttagataggaaataagttatagagagaaaaagattttagttttttttaaggaagaaggttttggtagtcgatatagttgaaggcgagggtcgtgttgtgagttcgtgtttgaggatttgagtagagattttagtgagttatattgttagggagagtgggggtagcgagatgatatttttttttattttgagagttgatgttgttataaatgattgtttatttttagagtttattggtgtaaaatataaaggtattagtttattaaaaaaatttataatttttttaaagtagtatggaatataaatattattttaatagttttatttttttaatttgtttttggaatattaagatatagatttaaagttgatattgataaaaatattaggttttgtttttttattaatttattatattagaaaaatttaggttaggtgtaatcgtttatattttttttgggaggttaaggtaggtagattatttgagtttagtttaaggttattttgggtaattatgtttataaaaaatgtaaatattatttgggtatggtggcgtatgtttgtggttttagttatttaggaagttgaggtagtaggattgtttaagttcgggagattgaagttgtagtgagttgtgattgtgttattatattttaatttgggcggtagagtaagattttgttttaaagaaagaaaaaaaaaagtaaagtaaaataaaaaaatttaaatattttttagtttatagtgttagtatagggagaattgaagattttagaggaaatgttattgttatttaaaaatggttttgtggagtaggaattagattgagggtttttattgttttttgtttgttggtttggttttatttttttttttatttttagtcgaggtaggtaaattgtttgagtataggagtttaaggtaagtttgggtaatatggtgagattttatttttataaaaaatttaaaaaataagtcgggtttggtggtgtgtatttgttattttagttatttgggaggttaaggtggaagaattgtttgggtttaggaggttgaggttgtatgtagttattatgtttatgttattgtattttagtttgggtgatagagtgagattttttgtttttttagttttgtttttttgtttttttttttttgattatagagtgttatagtgtttgcgaagtttattgattatttttagttttttatttgagtttttgagtatttagaagtaataggttatatagaaagttttaaaataggtcggtcgtagtggtttatattcgtaattttagtaatttgggaggtcgaggtaggtagattatttgaggttaggagtttgagattagtttggttattatggtgaaattttttttttattaaaaatataaaatttagttaggtgtggtggtgtatatttatagttttagttatttaggaggttgaggtatgagaattgtttgaattgggaggaggtagaggttgtagtgagcggagattgcgttattgtattttagtttgggtaatagagtgaggtttcgttttaaaaaaaaaaaaaaaaaaaagaaaagaaaaagaaaagaaagaaagaaagttttaagatagggtttaattatataaatttagtttaaatatatatttagggtatttgtaaggcgaaaatatttaaaataagaaaaggtgttttggaagtttttattatttggtgttaagaaaaaaagtattttagtaattaaatttagaattgtgttgggtttttttttttgtattttatgttgtagtatttttgtttttaattatatataggggaaaggataataaagtatttgatgttgagtatttttaaagatttttatttgatttaatataaaataaatagaatgattaaaatgattatgaggttgattatgtttgtaattttagtattttgggaggttgaggtgggtgaattattttaggttaggagttcgagatttggttaatagggcgaaatttagtttttattaaaaatataaaaattagttaggtatggtggcgggcgtttgtaattttagttattcgggaggttgaggtaggagaattatttgaatttagaaggtagcggttgtagtgagttgaaattgcgttattgtattttagttttggtgatagagtgagagtttgttttaaaataaataaataaaatgattatgaatattttgaagtgtatatttatttattttttttaattggtttttagattatagatatgtatgatgtacgacgtgatattttgaaatatgtatgtattgtggaatggttaaatagaattaaataatgtttgtgtgattttatatatttattattttttgtagtgagaatattttaaaatttatttttttaaagagatttttaagaataaaatatattgttatgagttatatttatcgtgttgtataatagattttttgaatttattttttttaattggaattttgtattttttgattaatattttcgttaatcgtttttttttagtaattattttagtttttgataattattattttatttattgtttttatgagtttaattttttgagattttatacgtag

SEQ ID NO: 38 - DNA, 21430 bp, Artificial Sequence
  chemically treated genomic DNA (Homo sapiens)
ttacgtatggaattttaaaaagttgaatttatagaagtagtgagtaaaatggtggttattaggggttagggtggttattggggaggagcggttggcggggatgttggttaaaagatataaaattttagttaggagaaataagtttaagagatttattgtataatacggtgaatatagtttataataatgtattttatttttgaaaatttttttaagagagtggattttaaagtgtttttattatagaaaatggtaagtatatgaggttatatagatattatttagttttatttggttattttataatgtatatatattttaaaatattacgtcgtatattatatatatttataatttgggggttaattaaaagaaataaataaatgtgtattttagggtatttataattattttatttatttattttgaaatagatttttattttgttattaaggttggagtgtagtggcgtaattttagtttattgtaatcgttgttttttgagtttaaatgatttttttgttttagtttttcgagtagttgggattataggcgttcgttattatgtttggttaatttttgtatttttagtggagattgagtttcgttttgttggttaagtttcgaatttttgatttgaggtgatttatttattttagttttttaaagtgttgggattataagtatgattagttttataattattttaattattttatttattttatgttgggttaaatgaagatttttagaagtgtttagtattaaatattttgttatttttttttttgtatgtaattaaaaataaaaatattataatataaaatataggagaggaggtttagtataattttgaatttgattattaggatgtttttttttttaatattaaatagtgaagatttttaaagtatttttttttattttgggtattttcgttttgtaagtattttaagtgtatgtttaggttgagtttatgtgattaagttttgttttagagtttttttttttttttttttttttttttttttttttttttttttttttttgagacggagttttattttgttgtttaggttggagtgtagtgacgtaattttcgtttattgtaatttttgtttttttttagtttaagtaatttttatgttttagttttttgagtagttgggattataggtgtgtattattatatttggttaaattttgtatttttagtagagaaggggttttattatagtggttaggttggttttaaatttttggttttaagtgatttgtttgtttcggttttttaaattgttgggattacgggtatgaattattgcgatcggtttattttagagttttttgtatagtttgttgtttttggatatttaaaggtttaaatgaaaaattaaaaatagttagtaagtttcgtaagtattatgatattttgtgattaggaaaaaggagataagggggtaaaattgaggagatagaaggttttattttgttatttaggttggagtgtagtggtataaatatgatgattgtatgtagttttaattttttgggtttaagtaatttttttattttagttttttaagtagttgggatgataggtgtatattattaggttcggtttattttttaaattttttgtagagatagggttttattatgttgtttaggtttgttttgaatttttgtgtttaagtaatttgtttgtttcggttaaaagtgggagagaagataaagttaggttagtagataaaaggtaatgaaggtttttaatttagtttttattttataaaattatttttaaatgatagtgatattttttttgaagtttttagttttttttatgttaatattatagattgaaaagtatttgaatttttttgttttgttttgtttttttttttttttttttgggatagggttttgttttgtcgtttaggttggagtgtagtggtataattatagtttattatagttttaatttttcgggtttaagtaattttgttgttttagttttttgagtaattgggattataggtatgcgttattatgtttagataatgtttgtattttttgtagatatggttgtttagggtggttttgaattgaatttaagtgatttgtttgttttggttttttaaaggaggtgtgagcgattgtatttggtttgagtttttttaatatagtaagttgataaaggaatagaatttaatatttttattagtattaattttaaatttatattttggtattttaaagataaattgaaaaagtaaaattattaaaataatatttatattttatgttattttaaggaagttgtaagtttttttgatgagttagtatttttatattttatattagtgggttttaggaatgaataattatttatagtagtattagtttttaggatggaaagagatgttatttcgttgtttttattttttttgatagtataatttattagaatttttgtttaaatttttagatacgggtttatagtacggttttcgtttttaattgtgtcgattgttagagtttttttttttgaaaggagttgaaatttttttttttttgtgatttattttttatttagttatatttttggggttttataaaataaaagtaagtttttttttatataaaagttttttagatttcggttttaaaaatataagtttatttttttttataggagtaagtttgatattatttttaaggtagattattttggttttaatttttaggttttagtatttattcgttgtttgatttgataagttatttaattttttggtgtttaatttataaaatgtgtaatataatatatatattttatataggtatataaaatattttagaaagggaagtattttgaatatatgaatattgtatattttttaaaattttttttttggtaagttacggtggtttatatttgtaattttaatacgtagggagggtaaggtgggaggattatttgaggttaggagtttgaggttgtagtgagttatgtattgtagggattataggcgtttattattatgtttggttaatttttgtatttttagtagagattgggtttcgttttgttggttaggttggttttgaatttttgattttaggtgatttattcgttttagttttttaaagtgttgggattataagtatgatcggttttataattattttagttattttatttattttatgttgggttaaataaagatttttagaagtgtttagtttttttaaaggttgtagtgagttataattatgttataatattttagtttgggagatagaatgagattttgtttttaaaagaaaaatgaaataaaatttatttttttttttcgttttttgagggatagggtgttatgaggaggatagtaagtaagaataatttatttattgatttaagtttaaatatttgttaaatagttgtttttttaaagtgattggtagaaaagtcgttttattgttatttattatatattaattaaattttttttagttattatttttgttttataataaaattgttgtattagaatttatttttaaattgggttatttgtttttatgagttatatgttagtgtgtagaattgcggttgtaattaaaggttttgaatattgtattaatttattttatgatatatagtagtgtgtggatgtgtatatatataagttcgtagattgaatgtttgtgtatttttaaaattaatatgttgaagttttaatttttagtgtgatggtatttgtagttggggtttgtgggaggtaattaggttataaggatggatttttatgaattgtgttcgtgttttttgaagaagagatatgagagaaatggttttttttttttttggttacgtgaggatatagtgagaaggtggttatttgtaaattaagaaaagggtttttgttagatatcgaatatgtggttattttaatttttaatttagtagtttttagaattgtgaggaataaatcgttgtttaagttattttgtttgtgttatttgttatagtagtttaagttgttaagtttacgtttatgtttggtaaaatagttagagatgtgttgttgatatggaatgtaaaatatatattatttttaatgaaataaaaattgatataagatttgtgttttagagtatatatttagattttaatgtaaggtattttggttgaaaaaataatatttataagaaaatttttttttattttgggtaagaaattataattttttgtagggagattgtgaaaaatatagatatttgggtttttagaattgtaatgttatattttttagtgagaggatttttaagaattttttttagtttatatgttaggattttatacgtttaacggtgataatataaaatatttgagttaatattattaaagttttttttgtgatggaaaaattttattgttatagtttaagaaatataggtttttttttattaatttaatataattaatagaagagattgggttattttatataaagttataagcggtagtaaaatgttaaaggtaaaaataattaagaagtaaaaagtatagaatagatagaagttttggagagttggggatggaagaattgaaggtaatttaagttttaattattttatttgggtaatttgattagtaatttagattttaaaggttgaatgagtttatagttgtaaatattaatataagttaggaggatagaaaaatgaaggtttgagagtagagaataagtggtttggttagttttttttttttttaattttttttttttttttttgagatgaatttttattttgttatttatgttgaagtgtagtggtaggattttaatttattgtaattttcgtttttcgggtttaagtaatttttttgttttagttttttgagtagttgggattataggtatatgttattacgtttagttaatttttgtattttttagtagagatagggttttattatgttggttaggttggttttaaatttttggtttgaagagatttgtttgtttcggttttttaaagtgttaagattataggcgtaagttattacgtttagttagtatttttttgtttgtggattttagttagagttggggtaggtttgggtattattttgtttagtttataataaattatagtttttttgtttttagatttattgatggggttgggtttttttagatttattgataaattagtttggttaagttaggattatttagtttaataaaatgttttaattttattttattttatttatttattttgttatttatttttaaatttataaattgtgagtatttttatttttttaatggcgcgtaatgatttgggggatttcgtttttgttaatgattttagaagtttgaattttgggaatttaagagatagtatatttgatagttttttttttagttttatttggattgtataattatttttttataaataaaatagaaaaataaaataagttaaaataaatataaatataagatattttagtgtttatgtttattagtttatataatgttatagttggtagttttagagatcgtttggtttaatttttttattttattattagggaaagaagggttagggtagggaagttttagtttaaaattttaattttgtttgttggtagaatcggttaaaaaaattttaatttagtttatgatttttgatgtggtgttttttttattttattatgttgttttttcggagattattgatttgaaaaataattttgttaaagttatttggagtttttattggtaattggtttattatttaattggtattttatttttgtttttagtaaaatttttttttgtttgttaaattggtttagtgtttataagtatttgattttaaatttggatggttatataaagaaagttttttagtttgtttagttttgggggtttttaatttgggatttaggaatttatgggttgagttaggggatttatgatttttataagttagtaaaaattttgagtgtataaaggtgtatttatttttgggttagggatatagttttttttaaatttttaagggattttatgagtttttattaattttgaattattgaattatttagttcgatttttttaagttagagttgaggaaattgagttattgagaagtgaatagatttgttaagattaaatagaatagagtaaagtttagaatttagatttttttgtgtatattttatatttttttttattatattagtaggtttgtgtatttgtatttttattcgatatgattttgtttttttgagtttatttttttttaatttatgttttttgttataagaggaatttattgaaggggtatgtagggtttaaaataaattaatttaagtttaggaatagtggttttttgtattttttttagtagtaagttaagattattattttggagttttgttaaagatttcgaggttttcggtttttttttacgtgggtgtttagttggagtttttgtagtttggagtttggtgtttaattttaatttttggtgaattatttgtttttttatttttatttttatttttgagatggagttttgttttgttatttgggttggagtgtagtggcgtatttttagtttattgtaattttcgtttttcgtatttaagtgatatttttgttttagttttttgagtagttgggattataggcgtttgttattacgtttagttaagttttttgtaattttaatagagacggggttttattatgttggttaggttggttttaaatttttgattttatgattcgtttgtttcggttttttaaagtgttgggattataggtatgtgttatttcgtttagttatttaggtgtgaattattaagtgatgttattaatgttttttttagttttgttatagttgtgtatattaaaggaaaattttttttattagagaagtgggtttatttggtggagatgaaggagtaaagagatttttaaggaaatgtagttaaattaagtattatatgtattgaagtatttagtagataaaggtatttttattataaatatagtgtttaattttatagtaataatagataggttgttttgaattttatttagaaggaggtgggatagaatttaaattaatatataaattttttttatgagtaggtagtttttatatattatgacgtttgtatttttaaattaattgttagttaaaaaaaattagaatttggttaggtacggtgattttttgtattttgggaggtcgaggtaggtggattatttgaggttaggagttttagattagtttgattaatatgatgaaacgttatttttattaaaaatacgaaaaattagttgggtatggtggcgtgtatttgtaattttagttatttaggaggttgaggtaggagaattatttgaatttaggagatggaggttgtagtgagttaagatcgtattattgtattttagtttgggtaataagagtaaaattttgttttaaaaaaataaagaaaaaaaattagaatttttaattgtttattgaatttatttttttaattattgattttatataaaattttttatgatttttggtgtggaaagaatatttaagattattatatttttaattttttgatattatagtaagaagttaaaatagaatgattaagaatgataaattaagaaatggtagttaataaaatatttttggaatatatataagaaattgataatgttgtttatttttaataaagagaattgagtgatttgggttaaggaagaagaaagattttttatggtaaattttttagtttttttgaatttgaattatgtattatttaattaaagtattaataaataaatttcgaattttgagaaaagaaatagtgttaaagatatattatttagatatgtaatttattattagaagaagtaattaaaaatggttgagggtgggggatggttaaattgtttttttgtattattttatttttaaatgatatgtataaattaatttgattatatataaaatgtatttatataaaattagaaaagaaaattatttttaattaattggttttataggtaaagaaattgaggttttaaggggaggagatattattattaaggtgatagattttagatgtatatatttggttgtgttttagtttagagttttttttaatatggttagggatttttggagtggttggtgtgtaaatgttttttaattattattattagatgattattagattaagatattttaaggatatttgaataaaattgatttttttttattttgattttttgtgttaataattatattttttttatttatttaattataagtaaattgataggagatatttatatgaggtagtttaaattttagttaatggagtgtttaatgattaattgattagattttaatttagagagtagttttgagtggtttaaaggaatttatgtaattagtttaggtttggtagaaattgagtgtatatgaaagtaagttttttatggttttgatttatgagggttggatattaattatatttgttaagaggtgagtagtttagttaagttttaggttttgggggaggttttgttataggtacggatgttgggatttggagtaggattgatgtgtgttttgggagggagcgggaaggaaagtgggggaaagaaagatggtgaaattagagaagggattcggttagagattttaatgaaattacggtggtgttttttattttatttaatttaaagtaaaaataatattaaatgttaaatatttataaagaagtttaataaaaatttgattttttttaggatgaatatttgaatttgtgtgtgtgtgtgtgtgtgtgtgtgtgtgtgtgtgtgtgtgtgtgtaattttaaaatttaaaattttttaaatattaaattatatatatagtttataaaaagagagcgagcgtagtttttgttttagtttgtttttagtggtaggtaaggttgcgtagggttgaattgagggagggggtagaaatttgatagtttataaagaaaggtataagtaacgcgtggggaggattttgagtcgcgcggattcggtaatcgtttttttcgcggtttaggggattttttaggtcgggacgtagtcgaagggaagtttttattcggaggcgtcgggaggagcgggcgaattttgatttagtcggggagttttgggagtcgcgttagtgcggaagcgtcgtcgggggaataggggaaatttgatttgatcggaaaagagcgatcgaaggggagattaatttgttcgtcggggttttcgttggtttcgtttgttcgtcggggcggggttatcgcgggggttttcgtcgttttgcggaagagaggaaagaggggaaggcgattttgcgcgcgttcggggacgcgggttttttcgtttcggtatatgggggttagagtttcgcgttcgcgaggttggagggaagttaagaggggttgagtgagagatacgcgaatagacgtatatagataggacgggagacgcgagtggcgcgcgggatataaaggcgtggaggtttcgaagttcggcgaggatagcgggcgttttcggtttttattattttttttgttcgcgttgtttaatttggtgttaaatcggatttatttgttttttttttatttttaggcggttcgtttttttattttagttagaggtgattttatttgagaacggaagaagtaaaggtatcgggtttttgttaggtttttttattaaatggttgtgtttatgatttgttttgggtaagttatataaattttttatgtttttatgtttttatttgtaaaatggaattaaaaattgtatttatttatggtgttgtttaggaattaataaacgaatgcgttaaagcgtttggaatagtatttcgtataggggaatttcgttatacgttttagatattattattagttatttatttagtaaatatttgtagagcgtttgttttgtgcgaggttttgcgttgagtttagggaggtaggggtgaattgggtaggtgttattaggtagttttaaagattaggaaagaaataaaacgggcggtgtgataacgtgattggagaagagttgttttaggtaaaaggagttagttaagttcgttttgttttttaggttttattgtttttttcgatttaaaaaataaaaataaataaataaataaataaataaataaatacggtttttaggcgttttgttttttcggtttaaatattttggcgtcggggttaaaaagtgggaatagggcggggaagggatgttcgttgggaaggaggaggagtttaagatttttgttttttttttgttttttggcgtttcgttttttttcgggaggaggagtagcgcgaagtttggagttttcgaaaaggttgaatggtgttcgggatttcgttagggaggaggtttcgggtttttggagtcgttgatcggggttaagttttttagtgggagttatgtattcgtattaggtatttttagggagagaatatttcgttttttgcgtagttgggacgtatagtgtgtaaagcggttttttttaagttttcgttttgttcgtgataattatttcgagagttgataggtattgttattttgattagattgtggtttatagagggaaaatgttgattttatttgattttaagttttgaatttgttttataatagtgtttttatttttttgagtataaaaaatgttttaaagtaacgaaatatttattaatgtttattatgtgttaggttttggttttacgtgattttatttaattattagagtaattttgagagagttttttttttagtttttttagttttatagatgaggatattgagggttagagtagtaaggttatttaagtaagagatggagtagttattttattttaggtgtgtttattttagagtcggagttgtttttattttaggaggatagtaaaagaattggaatttaaacgttaggtatattgggtagggtagcggttattttttggttttttttttttggttttttttttaggttttaagggttatgttatagagtattttttgtgtatttataattattaaagggtgaagtatagttttttttatttaaataagaaggatattggttattttgaatgaaagtttgtgatgtagattatcgttttgtttcgatttttatttttagggagatttgtttatttttgatggttttgtttttttttatagttttttgaatttagaggggattcggttggaaggggtgtttttattttataaaataaaaatttaatttatttatttaatagatatttagtgtttgttattttaggttagattttgagtagagtgttggatatgaagtagtgaataaaattgagattatttaggtatatagagaggaagtcgttggttagagataatatcgtttaggagtttaggatttttgttattaagttttgtttattagggttttagttatgttggaatgtgtatgtttagtttattttagatgaagtttttgttttagttaggtagtttttaaagttttatttttcggaggttcgatgtaggtttttatgtaaatatttttaaatattgattttatttttttttggtataagttaaagaaatttttagttgagttttggatcgtacgtgttgtaagttgatagaattaggaaaatgaaaatttgttttaggtgattttaggaaatatttttaattattttttaaaataaatttggggaagttttatagttggtagtagaggtttagagaggcgatatgatttgtttaaggttatacggttcggatgtatattagttttgtgtaaattttagatttgttagtattattttttttttttcgagaggtttgtgttttcgttagacgagtggtaaaggcgattatataattttggggaaattatatttttagttgttttttgaagtaagtcgaagagtgaggcgacggcgtcgtttcggcgtatttaggaggagggaaagggtggagcgtttcgttgatcgggttgtagtttcggtttgtacgtaggaattggtgaaaatatttttgcgtattatcgttttaggcgtttgaagaagattaggtttagaggtatggttcggagattggatttagtgttattggatcgttttggagtagattttgcgtttaggaggtagttttttttatttttttcgtaaaagttttttaaatttttgtagttgttaattaaaagaaaaaaaaagattaaataaataacggtagagaatttttcgaaaagaggatggaggtagattttcggttttttttagagttcgaatatgcgaaggttttttttatttgtaggaaattttgtagttcgtaaaagcgcgtttttttggagcgtttcgtttcggcgcgggacgtttacggttgttttttttgtagttcggttgggtttttgttttgtgttttatattattataggtaattaatattgtattagtcgtattttaaatttttaaaatttataatataatgtaatggtataagggtatttattattaaaggatattcgatggagagggaggtggaggaatcgttggggttgttgtgtaaggcgggggtaaagggttgaggtttagggagttgggggagattcgtaagttagtttatgcggtagggggtgtcgtattgcgcggagggtaaatttattttgtttcgaatttcggtttcgtggtttgatgattcgtaattttttgaggacgaagtagggaaatgtgtagatgatttttggatttggagtattaaattttaaattaggaaggcgtttttatagttcgtaaataaaaagagggagcgtaaagagaatagggagttggcgtttatggagtatttattatgtatagggtattatgttaggcgttttgtagtagttatagtagtatttttataaagaagtcgaggtggattttagagtgaataataatttggatgagaattttagatgaatttggaattttgagtgggttttattagagtgttttagcgaatatttttttttttttttgtttttattattttatttttttttaagttttttgaattttttaaaataatttgttgtttataaaatttaagtattagttgacgttttaaataaataattttatttagttttgataataattttgtgaaataagcgttggtttttttattttgtagataagtaattttgttggagaaggtttagagaaattaagaaattagttttaggatggttttgttagtgagtagaggtattggaggttcgaatttttattagttcggttttaaagtttattagttaagttaaattgagtagagttttatgatggtaggtagggaagtatggaaggaagtgttttgaaattttaagtttagatataagtcgtagggttttttacgaggagttttaagtgagtttgttatggaagaggagtggggagaagggatggttgggggttgggtagtagaaattgatagtttaattttttggggtttttttttttaaattttttttaaagttagtattttttagtttttgagaaaaaataaaattattttgattcgggttgaaaaataaagtatttattttagaagttaatttaaggggtaaagggaaaagaaaatttaatattttatttgtatttatttagagaatgaaattaaaggttatatagtaatatataaattatatgaaataacgaaaaaataaaataaaatttgggttagaggggtagggtgagaagggtttaggtttatggttttatttttttttttttataaaattataagtgaatttttatcgaaagatatttatataaagggaatggaaagaagtagaattaaataaataatagtaatgaacgatgttaataataatagtaataataaaagtgtaaggaggttagacgtgttgaaaggatttgtatataatgtagagaagttatagtcgttttttagtagtcgattgtacgttgagttggtaatttggtaagagtagcgagttggggttagagagtttttaacggttatgaatattataaattttcgttttttagtaagtagtaattattttttaaatattagtaggtagtgaaagatggttagagttggtgttggtagttgattataaatagttaagcgattttagaatttttagtcgttagattgggtttatttgttttggagttttatttattacgaaaaaatggtaatttggagttcgtaattttttgtatattttttttgaatttaatttttatgttattttatgagaatttacgttaaattaaaggataaggtgaatagaatttaggtaaggaagggagtataaggttattttttggaaatatatatgtattttatatattttaataaatttttagtgtatgtttgtgttttttttagatattttagattttgtgttattattgattattttttttttatttttttattttttgtttaatcgcgtttagtaaagtggtatttttattttagtttcgggcggttgggttaattgattgttttttgttttggggtttttgttttgaagtcgtgcggtttttgcgcgagggtaaattttagtattacggatagtataagtatatttaggttcgtttttttgtaatatttttttagcgttaaaatttttttggtgggaatagaaaggaaagagagagaaggtcggaggtaattaggcgggataaagggggaaagtttgtggtttcggaggagagagtttaatttgtttaggaaacgttttggagttttcgataattatttttcgaattcgggagggatgagtattaggttttttcggttttcgacgttgcgttttgtcgtaattagtggatagtcgaatattttattcgtttttgtttttgtttttggttgtagaattagatttttattacgttttttttaaggtttagttttttagcgatggtcgcgatttttttagatgaaggacgtggttggatagcgaaataggtttcgagtgaacgttttttcggcgtcgcgatggacgtgcgtttgcgttttcgttcgttgtcgttgaagagttttggtttgttgtttttttttcggtaggcggtttcggttttttttaattaggtttggagtatcggtttgagagcgattatgttgttgtgcgagagagtgagagattcgaatttgtagatggtgttttggtttagcgagtttacgtcggggattttgagattagttagagtcgcgtttacgttcgtttgggttatttttagtttgatgcgtcgttgtttgaagcgttcggcgaaggtttttagttcgcgcgggtttgattttacgtcgttgaggtatgtaggtatggcgttatgaggggttacggtgtgcgggtgatttatgtttatggtttggtgtaggtggtttatggcgtttaggtggtgtggatggatttgtgcgggtattatcgagtgtttcggagcgtttaggtcgtttatatttagcgtgggcgagatgtgttttagtaggtcgttttcgaggttttggtgtacggcgtggtgagggtgtgaggtgagcgtagttgggtgggagatgggtacggtggacgaagtggacgtgtagggtacgttgtttatggtatggtaggtggcgtcgggtttgaacggatggtttttgtcgtgggagacgatatttatcgtcgttagagtttcggcgcgtgttagtaggtttttattaaagtttttaaatatattattttgtagttgtaagcgagaaggcgtatagtacggttagtagggaatattgttaatataggattaaaatatatttttaagtaatcgagatgtttttttttaaagtttaggttataaaaattaatacggaggtagcggttttgttggaatagacgtgtggattagagatatgaatgagagagagagcgcgtcgggagagaacgcgggggagataaggagaggggtttagatagcggcgattgttttgggcgatatgaaaaaaatatgaagttagtgtttgttaaaaaatgtgttttagagcggtaattatgttttattacgtatttgcggggttgggagatagattcggcgtatggtttcggagttagagtgtagattggagaatttgggtttttgtagtatcgggtgtatgtcgaaaggttgtttggagtttatggttattattttcgcgtttttggtagggtggtagcgggtgatatggaattaggtttgtttagtttgtttgtcgttttttaagtgagcgttgtttagcgttcgcgtttttttcgttttttcgttcgttgtttttttttttttttatttgtttttttatttattttataagtagtttgttaggaagggttcgggcgcgcgtaggcgtgtttacgcgtcggggattcgtaggggcggttcgggaggtgaggagagatagtagttagcggcgcgtttttttgcgttcgcggcggtcgttttttttatagtttttatattcgggtttggtttggttttttttagttcgtttcgtttcgttggttttaattcgttagattttttcgattttttttttttcgtggatttttttttttttatgttattttaaaagttttaattttttcgttttgttttagttcgaattgtttggataaaagggtagttttgggttgagttggggtaggaagttgattttattttaattttttttttttattatatatatatatatatatatatatatatatatatatatatatttcgtcggttcggttgtcgttaaattgtttatttttagggcgtttttggttttacgtttaagttgtttattagagttcggtttcgcggcgtagcgaggaggcgtttttaagcgtttagacgggttttggagagggtgaggggttgttagaacgaggtttaggtgatttttgttttattttttttaatcgcgtttcggggtagaggtaggggtagtaattgtttttttagttcggggtggttttttttttacgtttgttttttttttttttatttgagggatgtaatttggtttattttttttttaattttttcgtttaaggaagtttgtggagtattttttttagaatagcgattgtttaggatggttttttaggtttgggagttttttagtgtatttttgttgggtagttagagtttgtaagtttatttttcgtgataatagttatcgtttaagagtttttaatatgtgttagataatttagagtttgtttatgggatttttatatttatcgtatggagtaggtgatgttatttcgttttatagatgaggaaaataaggattagaggggttaatgattagtttatttatttatttatttagttatttatttattttataaatatttattgacggtttgttgttttttaggcgttttagttttttggtttttttttttaaagtttcggaatttgagggttttcgaggttagtattgttcgtttttattttttttagtttttttttttttttattttttttttttttttttttttttgtttcgttttagtaaatatcgtgaataatggatggggaattttggatttcgattacgttgtatttcggttcggagagaaatttcgcgcgtgtagttgtattttttcgttagggttattgttttcgttgagagagcgattttcggggtttagagattttattttgtttgttattgtgtagggtatgtgcgtgtcgggttttttagaatttgaacgaggtggggtggtgtggtttaggggaatattttttagtttaagaggacgttttgatagattcgggttttttttttttttcggcgttttttagttgtttttttttttattcgagttagtttttttcgttggttttcgttttgcgatggtgggaaaaagatttagtttaggtgtttagagttaagcgtaattttttcgttaaagttttttgagtttcggtttcggcggtttttaaatggaattgtattattgtttgtttttttggattttggtgaagacgtttagagttagggtaagaagaaaagtattgagttacgaaattggtgtttagtaaatttttttataatttggtgttatagcgtttaggttttggttttagatttaaaatgcgtttttgttttttgttggttgagattacgagatatttttaatttttttgtattgcggtgtttttatttgtaaaatgggggtgattatttattttttattgattgttgtgaggaatgtattgggataagtatatggtatagtgtttggcgtattgatattattgaatatatgtttttttttttttttttaatttaaagagaaagtatgtgagagtgggggtgggttaagttatttttttggaattcggtttgtttgtacgtgtatattgtggatttttgttttttatttatttaatatttgtattgtgttagattttatgttaaaggttgggatatagatgtgaattagaatttattttggtatttaaggagttattagtttaatatttattttagaaagttaattttaaatttgttaagtagtagaagggaggtagatttatgaataagatatagagtataagggtggtaggattttagaagtgtagaatatatattagaattatgggttgtaggagggttggatttggggttgtattttgatacggagtatgggtgattttgattggattttagtttatttataaggagtgggttgtataagatgattgttaagttttaataagatttttagttttaataagattattattttggttaatttgaatgaaatatattttgagtatgttaggaatttatttttagagatatttaattttttagagttgaatgtagtattttattatttattaggatttaagattagtttttgttttttttttaatgttggaagtttaaagggaaaaggggaatgaaatatagggatatattggtttgtattttgtttggttttatgatgttttgagatttataattattttataatattttagttgtttgtgaagttgaatttttagaaattgggagagaaaggatttatatttattttttttttttgttttgtttttttaggggtttgggagatattggttagtatagaggttaggtatgagttagaaatagagtaaaattaattggtttttatatgtttttaatgttgatttttattttattagtttttattttagtatttttaggtattaggattatatattaagaaatatatttgtgtttggttttatgtgttttagggttttttttatttttttttttaagaaggtttattggtagttttaggtagttagcggtaagataatatttatttttaaggattagtttttttgagaaggttttggagataatagattggagattggagaagaaaagagggaaaagattatagaaaaagtaattggaaggatagttttagacggtaatttgtaatagtttttatgttttttagaatttgtaaatttaaattttataaggtgtaaaattagtaaaataaaattgagtaattttatttgggtggataaaaggaaagattgaaattgtggtaaattagagagtatttatttatttttttttttattattatggtattaaattataattatatatatatatatatatatatatatatatatatatatttatattatttatgggttaaataaaatatgtgaaggtttatgtaaggattatgtgggtatttatgtaagtggtattgaaggaagaattttttttattcgataagtatttttaaatatttattaatagtagagttttgtggaaggttttgaagatatagaagatattgttttaggagtttagagtttagtagggatatagatttgttatatgtaaggtgaagttagggtataaagtattatattttttagaaggattagttttgtagagatgtaaagggggtaggggtttgggggtagatgtatttttttgtgtgttagcggtttttaattttagtatgtgtaggaattatttgtaattttttaaaatatagtattataggtttatatttagagatgttgattttaaaaattaacgtgttttttaatagatatttatgattttggatgtagaggatttgggattttgaatttgaaaaatttagtttatatttttgttatttggattattattattattattattattattattattattttaaaattttgttttaattatgtaagttttatggagatttaaagagagttttttttttttgagtttttaatgttttttgtatttttttttattattttttagtaagaacgtggtgttttatgatttttgttttttgaagaattgtttgtgtttttagtgtttatgtttataggttaggtaatattaagagtttgatgtaatttatgttgaattaatgaattttggttaggggggtgtttatgatgatggtgataagaagggttatttatggagtggtttttatgtataaggttttgagttagatgttttggaagtgttgtatattgagtttttaaattaagtttgtgaggttgatattattatttttattttatagatgaaaaaaaggaggtatagaaagattaagtaagttgtttaaggttatatagttaggtagtagtagtatggggaagggagttttggtttatttgattttggagtttaggttagttttaattaatattttgggttggtattagttattttattttttaagtttagggttcgagggagtagggtgagtaggttttatttttttttttgttttcggaggttggttaggttttaggtatgttttcgggtataggttgtatttggagaagttagtagttatttttatttatttttatttttaagttttatattggagagttggaaaaggggtagggagggtggaatgggatatggtttcgataggagggttcgaatttaagatgttatcgcgtagcgaggtagttggcggggttgtttggttaggtgttcgtagtcgtttgatttgtttttttttttttttttttggtcgttttttataaattttttatatgtattcgtcgtttgcgtagttgttgcgggattcgtttgttggtcgttgttttgtattgtttgtaaagtggtttagaggattcgagacgtttagagggatttaggggttagaggtcgagcgttcgtgagggttcggtacgtgttaggagttttttttttttttttagatgtttcgttatggatatagttttgggatttaggtagtaggattttaaataggtttttgtttttttagtttttttatttgaaaaaatgagtggatttagtcg

SEQ ID NO: 39 - DNA, 26652 bp, Artificial Sequence
  chemically treated genomic DNA (Homo sapiens)
gcgggtatgtgcgcgcgagagagattgagtatttttttgtaattttttattttgtttgtttttaggtgttgttatatgaaatttttgaattgaggatttttattagtttttttaggatttaaggatatagttttggttataaatggtgttagttttggtgggggagttgttgttgttttatttgggtttaataaattttattaaattgttgtgtagttagtttttagcgttaagtggaaatgtttggagtttaatgttggtatttagtttatagtttcgtttgttttttttttttttgttattttttttattttttaaatttaggtattaatttttttttaatatttattaataagggttgggtttttaatgggtagcgtttatgaagtaagggagatttttatatagagtgaatatggtacgggggtggggaggttagggttatagaggattgtgtttttttttttattgtttttagagattttttttttttttgatttgaggattaataggagattaggattaggggttaattgtgtgttttttttgttattgtattgaggagaggttggtaggtggatgtggatagtaaagcggaaatttttagtaggtattatttaggtagaagtttaataagtgtagtgatttttttttttgtttttttggtgaggtattaggagggtttttttttttttttttatatttttttatttttgttttttttgtagtttagtttttttttaattttttttaaattttttttttttaatagggtgtatagattttagttagaaaaataggtagtttttaaatgggattgttttttattgttaatgaaatgaatatttagggattgggtttttttttcgtttgttttgggtttgatgtggttgtatttcgtgttattagaggagttttttttttatttaagtgtgtttttttgtttagtttttttcgtagatttttgttgggttgagttttttttgtttttaagagttaggagtggtttttgttgggatggaatgattcgtttttggggttgttttatgagcggtttttgtgaattcggattagtttcgatgtgtaaattttatcgtttggtttttagcgaatagatatagatttttgttattttttatgattttatagtttatgggattgggtttggggtagtgttagaggtacgtatggaggtgtgattttaggtgagttttgcggaaaatttttggtttattcgtgagttacggatagaatatgtagatttaggttttggtgatataagtttcgtattgttaaaatcgcgtgatttcgagggttgattggtttgagaattttggatggcgttttcggttatttttattttttattttaattttttgggtttcggttagaatttatagttcgtgttcgaagagcgtttttcgtttttggtattttattttcgtttagttttagggaaaaggggagagggtagttttttgtagttagaggaagagtatattttttttggttgttttattttttgaagtagggcggttagttgaaggaggatatatttttgaggggtttagaggttgtttaagtttttttttgttttttgaagattgtgtattgagttgggcgtagttttcgggaattgtttttatttagattgttggggggcgggggggtaggatgagggtagagtcgagaggttgtttaaggtttgggagagagaaaagttttttttaggattcgattttggtttttagtaatcgcgatagttaaaaacgggtgtttcgtttcgataatagattttcgcggattttttggtatttggtttattagcgttcgcgaattttgtttcgggagatttattgaaattcggatgtttaagtcgggaggcgcgtagtaattaggaggatgagagggtcgggtttgggttaggaaagcggttttttaaaatagatgttagggggattgtagtttcgagttatgagaaaaaagttaaaggcgagatgatacgtattgaattggggtaaatattggaagaggagataaaattgcgtgtttgagtatcggggtgcggggagggggggataaaattcgtatttagtgtaaattaaaattttgggagtaggtgggggttgttgcgcgttttttatttttagtttttttattaaggattttgagtttttatgtatttttgttttttggttttttttttttttttcgttcggtcggtgagaggcggtcgtcggcgttttagtagtagttagatgttaggcgaagttcggagcgcggagcgcggggaagggaggggaagggaggggaggggaaaggaggggtggggcggggagcgcgcgcgggttcggttagtgcggggtggtgggcgggttgagttcggggacggcgcgggaggggggagggaaggggggtagttgtgggtagggagtcgggttcggtcgttagtattaaagatggagaggcgtcggggttttgtaggggagggggttcggcgttgacgtgggacgcggcggaggcgtagtagtcggtggtgatttgttaatttcgtagtagagaggagttgagggcgatgagagcgggtattgcgaattgtcgggcgatgttgtcgttgtcgtcgtgatacggagagtaatagttttttagtaatattttttttcgatataggtatatatttttcgataggtacgtatatttattttatagtgttcggttcggttgcggtgagtgaggggtcgggaagaggcgtatcgtttagcgagcgtcgcgcgtcggggtttttcggggttggagaggtttggggggcgcgcgttcgtttcggttattcggtcgttgggtttgtgttttttttatttggcgtgttttttttttgtcgttgtagtcgtcgtcgttatcggttgggggtcggttagaagggggagtttcggttgttagtttgggcgtagttgtttttttagttttttttttttagggtacggtcggggtgagaggtggggggcgtagcggtgtgcgggggttgagggcgtgagtagaggggtcggggattcggaggttttgtatcgttaggggttggcggagtaatagagttcgtgggtgtttttatgtatgcggatcggtgcgcgggcgtaagataaggttgtggtttatttatttgtgtgtttattcgtcggtcggttgggaagttagaatcggaggagttgacgagtagatttgggggcggaggggagtaggattgggattgtttacgttttgtttttttttgagaaaacgtggtgggtttttttttgattggatttgatttttattttttttttgtaggggagggagggaagttttagagggtttgtagcgttgcgggtttttttcggttttcggcgggatcggcggtgatatcggagttcgtcgtgcgttttcggtcgttttcggtgggtgtcggtttttgtatttgatgcgttcgggatgttttttttattttggcgcgttcgtcgttagttcgtatagcgtttcgtatattttcgtacgcgtttgaaatgcgtacggtttcgtcggttcgcggaattattcggacgtacggagcgtttcgtatcgattcgttcgtcgttttttcgagacgttcgtatcgtgtttgggtcgggcgcgttggtcgttggcgtcgttggttagaggtttgggatttagtcggtcgtttttagggggttacggttttgggtcggagagggagggcgggtagattttttttcgtttttttttttataattcgttgcggggtttttgtgtttttttttcgtcgcggggcgggttcgttttttttgtcgttttcgtcgcggagtttagttcgttcggattgtcgtcgttttttttcgtttttttcgttttttttcgtttttagtttagtttttttttttttaggagtttagtttttcgggaaaagttgtttttttaagtttgttgaagtcgtttttaagtttcggtgggggtcgttgggaattgggggggtgtgagagcgcggtcgattttcggagttcgggcgggttatcgtcggttttttttcgcgtcgtttggttggacgttgtagttagcgttagtcggatcgcgggcgtcgagcggcgggtgggggagacggttgttcgtgggcgtttagattttttttaggatttaaaaggtttgttttagggcgttaagtttttatttttttggttgtttttttttagtttttagaaatttcgatgtttgcgggaaagtacgcggtggttcggttcggttgaatgtttattttaattttgacggttttcgtttttatttcggggcgggtagtaaaaatgttttgattagtcgttttgtgaattttttttgcgtgagtttggtggtttttgaattgatagagttttttttgggggtggaggtaagtaagtagtgttcgaagagtgagggagagattttgttgttttttgtttttagtgtatttattgtaatattggtcgttgtaagatagatacggggagggttttgggtttgcgcggtttttttaatatttttgtaagcgaggtttggagtttaggagtttttttattgatttcgaataggttttgggagaggtttttgttttttagttttgtttttttttcgtattggttgtaatttatattataggtgttggtgttaatattatttttagcgtttttgagttatgtttagtattttttgttgtttttggttataggatttgtagattttttggagtttgtgggatatacgtggagtttatatatttagtttagtatgagtatttttggttgtaggggattatatttaattatggtttttttttatattttaatgatttattttttttcgttttttagatttttttgtttatcgggtagttgtgggtaggagggtaggtacgatattttacgtaagtgtgtgtgtgtaaatatatatatatttttttttttttttttgagacggagttttgtttttgttgtttaggttggagtgtagtggtataatttcggtttacggtaattttcgtttttcggttttaagtgatttttttgttttagtttttcgagtagttgggattataggcgggtgttatcgcgtttggttaattttgtattttttgtagagacggggtttttttatgttggttaggttggtttcgaattttcgattttaggtgattcgtttgtttgggttttttaaagtgttgggattagaggcgtgagttatcgcgttttgttttatatattttttttgtttgtttttggttggtgtatatatatatagtttagattttatattatatatataataattttgaggttttcgtgggtagaaatgatttaagttagtgtgtgggttgtgtgtgtttttgttagtatttagggatggggataggttttgggtttgttagtgttttgtagttttgagaatagtagaaggttagaggttaaggttgatggtgagaggatagtttttgcggaggagagtttagtgtttatagatttttgtggttatggttataggtttttggtttttaatgagtttgattttgtttttggggtttttgtagtgaggtagagtttggaaaaattgtttaaagataaggtttgatatttagggggttggcgtgaagttgataaggaaggggttaaagttttgttaattttaagtaagtgtattttattataatgaatgttggttttgtttagggagtttttatttttagatatagagaaagttgaggatttataggattttattataatttttattttattttatttaatagatgttatagagtagtgaattaggtatttgttgtggtagaattttttttttatttttagtatttttggtttgaaaggtagatttgtagatttttaggaagttattttaattaaaatttttaagatttttttgttaagggtttggtaatagggaggagggggtatgttgtagtggttgaatttttatttttagggatattgatgaatttgttttttgtttttttattttttttgtttttttttttttttttttttttagttttttttattggtttaggaagtttatttagtttcgttacgtagagtttagaaggaaagaaagttttatgtttgagtcgaggggagtattatggatttgataaaaatgggtatgatttagttgtagaattttagttattttacggggttattgtgtaaggttaattagatgcggttggtcgggattttgtgcgatgtggttattatggtggatagttaggagttttacgtttatcggacggtgttggtttgtattagtaagatgtttgagatttttttttatcgtaatagttaatattatattttggattttttttcgttaaagattttttagtagattttggagtatgtatatatagttacgttgtaagttaaggcggaggatttggatgatttgttgtatgcggtcgagattttggagatcgagtatttggaggaatagtgtttgaagatgttggagattatttaggttttagacgataatgatacggaggttattatggtcgatggcggggtcgaggaagaagaggatcgtaaggttcggtattttaagaatatttttatttcgaagtattttagcgaggagagtgggtatgttagtgtggttggatagagtttttttgggtttatggtggattagagttttttagtttttattttatttggttttttagttatgagttttattaaggttgtagtggatagtttgatgattataggatagttttttttgtagggaattttttagttatttgtagggttcgaggagttaattttggttgggggtgggcggtattttggggtggttgaggtgaagacggagatgatgtaggtggatgaggtgtttagttaggatagttttggggtagtcgagtttagtattttaggagggatgggggataaggttgaggaaagaggtaaagaggggtttgggatttcgattcgaagtagcgttattattagtgttagggagttatattatgggcgagaggagagtgtcgagtaggtgttatttttagttgaggttggttaggtttttattggtcgatttgagtatttagtattttcgtttgagaagtatttgggtatttatttcgtgttgtttaattataaggttgacgttgtattgagtatgtcgtttttcgtgatttttggtttttacgtgtagtttgttttggttgtttttatggattttagtatttatggggggttgttgttttagggttttatttagagggagttgtttagtaagttgggggagttggttgtgggtatgaagttagagagtcggattatcggagagtagtgtagcgtgtgtggggtcgagttttttgataacgaggttgtggagtagtataggtaggtttcgttttagtttcgtatttgatgtaggatttgaggtttttatattttttttttatattttggttgtttttaagttaggggtttggtttttttgttttggtaatttgtgaaaaaattagaatattttttttaaagttttggcggggaggggagtaggttttttaaagtgtagtgagggggtttaggatttttttaaaaagtattaggggatatttatgggcgtagttttttaataggtttttttttttgttttttgtttttgggtttttgtttgttttttcggttgtttggtttgtttttttttgtttggagtgattgataaaatggagagaaggagaaaaggagtgggatgagggttttttgggttttgtatttgattatgttattaggttttaggttttcgggtttttatgtagtggtttttgtgaagatagtttgtttttttttgtagtttgggagaatgggagggtttgggggttgtttaagttataagagtagttgtaggttttgaattttatttttggtgaaagttaatttttttgttttgtttttttttttattttttgattttgtatatgtatttagggggaattgatttaaatgtaaggggaaaggatgggtataagagttttggttttgtagtttgtgaagttttatttttattttatttttgtttatattgaattaaatgtcgttttaggttagtattggttttttttcggttttcgtttttttttttatgaaataattatttattgagtttttatgatatgtttggtttagtattaagtattttttatgagttgtatttttattataatagttttttgagataggtaatgttttttttttttttttggatgtgaagtttcgttttttttgtttaggttggagtgtaatggtgtgatttttgtttatcgtaatttttgtatttcgggttaaggtgatttttttgttttagtttttcgagtagttcggattataggtacgtattattatatttggttaattttgaatttttagtagagacgggtttttatcgtgttggttaggatggtttcgaattttcgattttaggtgatcggtttgtttcggttttttaaagtgttggattataggtatgagttatcgtgtttagttggtaatgttttttttttatatggaataatattaaggtttagatgttaagttttttttttagggttatatagatagtaagaggtagagttggatttaaatttaggtttttattttttggtattttgttgttttttggagttatttagatttgaagaggattatgtttatggaatagagcgttttgaagattgtttataggaagtggagtaaataataggggggataagtagcgagtttgttttttttttttttgtttttgttataaattacgtgtttattattttattttttagtttttgggttagatgaatggagttaagaaatttagttttttgttgttattgacgatagtatttggttgtatattttgtggtttgttgttttgttgattttgggtggattttttattttttttttttttatttttatttttttgttgttcgtttaggtacgggggatgtgagtgagaggggttggggtggggatatttggaagttgattttattatttttagtcggaatttgttttgattttgttttttcgatagtttagaggtttaatttgtggaaagtgtggtagagttaaacgtagtcgattttttttagtgggtgcgaaaaataatcgttattaaggtgtgtttttttgatgtttgtatcgtttagaaatagattgaggttgtgtttgtttttgtttaaatttttttaaagaggaaattcgttttttaaagttgattagatagatgtattattttttcggatgtgaattatttcggttgtgtgttatgagaattgggtatggtgggaagtaattgtttttttggtttttattaggttttggtttttggttgtttttttttattcgagagggttataaaagatattatttttttgagatttttaagtttttttttagtaagatttttatttttttggggagagagggagagttggttatgttatattcgaaagagtttgggtattggaattggttatatttagtggtgagagtttgtgatatttatttaatttttttgggttttgttttatttattatatttttttttttttttttttttgagacggagtttcgttttgttatcgggttggagtgtaatggcgtgattttagtttattgtagtttttatttttcgggtttaagcgatttttttgttttagttttttgagtagttgggattataggtatttgttatttcgtttagttaattttttgtatttttagtagagatagggttttattatgttggttagaatggtttcgattttttgattttgcgatttatttatttcggttttttaaagtgttgggattatagttgtgagttatttcgttcggtttttatttattttttaaaatggagacggttaatagggttggtgttgaattaatgaagtaagatttagaaattattagagttgtgatgggtatatagttatcgtagcggtggagaattgattatttgttttttgtgttgtttaggttttatttttgtatggtttttattggttttgagttttagtgtgtagtgtttatagtgttattttttatgagggttgtgttgattgtgaggtggtgtagagaatgtttttgtttttgtgagtatatgatagtaagatattggttttggaatttttcgtgttatatgtgggttgttgataggaagaatgtgtttttgttgttgttgttgttgttgaggtagagttttattttgtcgtttaggttgtagtgtagtggtatgattttggtttattgtaatttttatttttcgggtttaagtgatttttttgttttagttttttgagtagttgggattatagatgtgtattattatgttcgattaatttttgtatttttagtagagatggggttttattatgttggttaggttggtttggaatttttggttttaagtgatttatttgtttcggttttttatagtgttgggattataggtgtgtgttattttgttgggtcgagaatgtgtttttgattgagggtggaaagttagtagttgtagtttaagaagttagagttaggggtagtgtttttgatgggaagtttgggggtttaaagaaattagaaaggggagaaaataattttgcgtgtgtttagtttttatttagattaatagtttttcgggttttagttagatgtattttgtagaaggtttttttttttttttttatttttaaaattttaggattaatgtgttatttttttttttttattgttttttgtttttttttaatttattagtagtttgagaaatgttatggtggaaaaaaaaaaataatagttttataattagtataaataaaaagttaagataaaaaaaaaaaaaaaattagaaggggagattttgaggttaggaagttatggtatttattggaaatatattagtgataaaataataggttatagggtttattttattttatttttaagttaataggtttgagtgttggtaaagattagatatttagtagttttttttgtatttttttttggggtgggggggtagaagggaatggagaggaaatgaaggcggattgttggtaagtgaggtaggaaggtagggagtttattatggaatgttatcggtaagtttttttatgatttgattttaagttggtgtggagtgaagggtaagttgttggtttaatagatagtgagaattaaatttagtggagttgtagagtttgttttttgtagcggatagtaagatgtataagtcgtttattgtaggaatgacgtgttgtaaaagggatgtagtgttaagtgtagttatggatgggtgggaagattagataaaggtatttaatgggattgatttatttaaataaattagaaggaagttagaatagtgggaagatttgatagataagtagtattttgtaggtagatgaaggagtaagttttgggtttttaaatttttattagtgtatttatattatagaggataatgtttgagggaggggaagattattttaggattttggaatattgggtttttttttttttattttaaaaggttggagtagttttgtatgtaggtttttttggaaatggtttaggaattagtttatttaggttaggagtatttgattatttttagagttacgtatatatgcgataagattgtagggaatagtatagttttatagatttaagtgtgaatatagtttttatttatagtttttagttttttatggtttacgtagtttggtttttatgtgtttttgaatttagtgttgtagaggtataatggggtttggtttttggattttatatagataagtatttaggttagttgtagtggatgttttgtatagatatcgtcgtaatttttgtttggtttttttttgtttttggagatggagtttcgttttgttttttaggttggagtgtagtggcgcgattttagtttattgtaagttttgttttttaggtttacgttatttttttgttttagttttttaagtagttgggattataggtattcgttattacgttcggttaattttttgtatttttagtagagatagggttttatcgtgttagttagtatggtttcgattttttgaattcgtgatttatttgtttcggttttttaaagtgttgggattataggtgtgagttattacgttcggtttattgtttggtttttgaagggatttttaggaattatagggaatgtttgagttagttttttggattcgtgtgtatagttttttttagaggttttgtggagttagttgtacggtgtatgagttttgtggttaagatattagagttttgtttggtttttggttttggttttttttagatggttagttgttttgtttttagtggttgattatgtagaaggttaataggtgttgattttggtttaggttatttttgggatttttgaggttttttgagatttttggtttttttttattatttcgtttagaatttttgatgttaaattaaattttgtttggaaaagggtatgttgtagaataatgatagttatagtaatgatattaataatattttttatcggttgtagtatttttttttttgtaaagtatttttaatgattttattttttttgtttttatagttttttttgagtgggtataggtttataattttatatttgtgataatgaagtttgaaaagttttgaaaattaaaaagtttgtagtaaatttatttagtggtaaaatttgatttgaattgatgtgaggttatatttattttgtttagtttgaatatttatatgttttgttgtaaaaatattaatgtgtttgattatagagtgttgttttagattttgttggggttgttaaatacgataggtgttagagtatttttttttttttttttttttttttttttttgagacggagtttcgttttgtcgtttaggtcggattgcggattgtagtggcgtaatttcggtttattgtaagtttcgtttttcgggtttacgttatttttttgttttagtttttcgagtagttgggattataggcgttcgttatcgcgttcggttaattttttgtatttttagtagagacggggttttattttgttagttaggatggtttcgattttttgattttatgatttattcgtttcggttttttaaagtgttgggattataggcgtgagttatcgcgttcggtttagagtatttttttaaagtttgaatagttttggtcgttgaagtatttgaaggttttggataagggattatgaacgattattattttttattgataaatgaggaaaatgagatttggagtaagtaagtgattttttatggttatatagttataaatgggtagaattaggtatttagtttgttttttaatttatagttttgggcgttttgtattaggttatataagaatatgagtattgtttttttgggttaaatttatttgatttagtttttggttgttattattatgtttaagatattattattggaggttataattattttttttgacgttaattttaaaggttaggtgtagttttttttagtagttatttatggttgttttgttatttatagatttgttaaaattttttttgaatttatttttatttttaggaagtattttttttaggggtgatgaatgataagtttataattttttgggtttttggaaatttggttttttggagagaggttgttggttgtgaagataggaagatggtagaaggttttgtagtggtgaggttaggtttagatttagttttgcgttttttagttttgttattattgatatcgttttttttatcgtgagttttaatttttttatttttaaaattaggtattttagtgagttttttttggattgttgcgttttttaaaaaatttttttattttttgtgtatttatttatatttttatgaagtttttttggttaattgaattttgttgttttggaatttggattggtagtttagttagttaagtagggggttagtttgatttgattttgtgtgttttgattttttttttttttttaaaatattttaatttgtttagggttattgagttatttgggatttagattgaatttttggaatttttgaagatgattttttttattttatttttaatggaggaaagttgtttatttttttattttagtgagaagttttattttaatttgttattattattggatggagtcgttaattgttgggagggagaaagttatagtttagtaatacgttttttttttgttcgttttaggaaaattattatgaatttttaaaatagtgattattttaaattgttaaaattaaattttatttatagttttttgattttttgttaatttaggagagaaatttttttaattattttaattttttttattaatttaaagtaagttttgttgaaagtttaagtatatatgatttagagttttattaaatgaatataggtgtgttttagtttgtttattggagggtttttgaattttttataattaaagattttttattttgttttggttgggtgtgtggggtgaaagtttttattttttggtagttatttaagtagtaagaaatttgttataatttttttttatttttacgttttatagataggaaatgagtattttgattgtttaggttagatttttgattttgttatttattaattgtgatagtggttgtgttatttaatttttgtgtgtttgtttgtttatttgtgaaatagaaataatagtagtatttattttattgggttgttataaggatttattagaaaatatttattttgtgtgaggaacggtggtataaagtaagtgttttataagtgtttgttagggtattttttttgttattgtgtgaagtaggttatgttagttatgtagggtgaaaaatgtgtttatgttggtttagattttgttttttttttgagatcgttttttcgtataggcgttaattcgtatagtgttgtaaaattgttgtttcgggtattttatgtttggggttgagatattgtttttgcgttttttttagaagttgattttttgtattgtggtggttagggtattttttgttttattgatttgaggtttggtgagttattttagttttcgtttaaatttagtcgggtagcgttttattgttatcgggtttaaatgtcggggaggtttattgatgcggtgttttgttgtttgtgtacgtggttaggcgtgtatattattgtgtttatgagagagatgaagagtatagatattattttattgatgggggttttggggttgggtttgtgggtgttgggggttttagagtttttttttttttttgtttgttagtgtaggatgtttttaaaatgtggatttagtagatattgttttgagtgtttgttatatgttagattttgtgttaagtgtatttatagttagtatttttgtaagatttttagttgttttgtaaggtgggtattagttttatatttttagatgggcggagagaagtttaagaggttagtggatttttttttagtaaagagttgtataggtcgggcgtagtggtttatgtttgtaattttagtattttgggaggtcgaggcgggcggattacgaggttaggagatcgagattattttggttaatatagtgaaatttcgtttttattaaaaatataaaaaattagtcgggcgtggtggggggcgtttgtagttttagttattcgggaggttgaggtaggagaatggcgtgaattcgggaggtagagtttgtagtgagtcgagattatgttatttattatattttagtttgggtaaaggagtgagattgttttaaaaaaaaaaaaaaaaaaaaaagagttgtattaggatttatgtttaggttttttggttttatgttttttgtagttgggtgattagggggtttatggttttattagttttggtttttttagtttttttggtggttttttgcgaggaggaaggttattgtagagggtttagttttttaggggtttaggtcgtatggatttaaggattagtacgttattttttattaatatagagagattagtttttagtgatagaggttttttatgttgatttgaaaaatagaaaaagagagaaaaaagaaatttatttataaaaataaaaattttatgttgttaattttatgttagtataattagaaatttttttttttattgtttttttttaaaagtttcggtgtttttattatgttggtgtagtttggaaaaattatggttgggttttgtttacgtgaggtttatttttgtagttgtaaggaggggattcggtattttattgttagtatggaaattttcgttaaatatttagaaaaattttaattttaaatttttagtttatttttaattgtgttttcgggatttgatttttttcggtgtgaatagattgtgtttagtattgtagtagaaagggtttaagttaggtaagagaaaggattttttgagatattggggtgttattgagaaagttgttagaagattgttatagatattttgatgaaggggggatattttgggttatttgaagtggtttttagagtttttttttttttagggttattcggtttttttagaaataagaagaaaagatatatatacgtatataaattattattattaggtttgttgagaataagttaaatgtgttattaaattatcgttttagtgggagatggggtggtattgtaggggtagaaagattgacgtttgatggatttgggtttgaatattagtgttttatggtgaatttgggtaaatgattttatttttgtgaagtagtagtatttttttttgtgaagtgaggttagtttttattttttaatgtggtttttaaagtatgttaatgagattatttgtaatttaaagtatatagagtgtgaggttatttttttattttttgttttttttatgattttagtttgataagggagtcgttgagttttttgttatttttattcggcgttgtgttttaagtggattagtttagcgttgtgattttaatgttattaggtttgttggtacggttttttttgttatagtgagaagtagatgtggtcgattataatggtttttagcgtgatttatcgggtttatagtgttggggtaattattattagtgttaatttgggggagttttttatggtagttgggggaaatgtggagggattgttggaaatttatttaagttgtttagtaggttaggtgttgttggggtttattatggtaaaatttttagtttttttaatttatttttttaaggaacgtttttttttaatatcgaagtttaggtttgattatttttagagttggagagataatttagtaggtttttgttttttgtcgatgtattttattagtagtatttggtattataatttattaatgggaattagtgttttttttttgcgtggttagtgataagtagttttgttagtcggagttcgtcgtgcgaggaagtttttattagttttatggttaggagaatttgttttgtttaggaaatgaatgttgtcgttaaaggttcgcggttttgattttggcggtataatttgtgcgggtcggggagattttgtgtaggatgtttgggattttagtttttttttggtttttgttatatgtaaagagggaattattgtggtatgttgtagttttgaatttttgatttatgtagtgagggcgatttaatcgtttttatgtttggacggttgtgtagtgatagagtcgtgttgtgagcgtatgtgtttaggtatatgtgtgtgtggggtggttaaggggaaggagagatttttacgtgttagtaggggttgttgttgggagtgggtggattttatgggaggattttttttttttttttttttttttgtatttttgtagtatttaaattttttgcgattgttggttgtaaagtggtaagaagttggagagtattgtgtttggaattgaatttgggttcgaattaattttttgttttttagaggttgtgtgatcgtggtaagattttttattatttatttttttatttgtgagatgaagttaataatttttgatttatattggtggtagagtagtgttgttaagtaggtgatgtatagagaatatatggtttagcgttcggttagtggtgtggttttaggttgtatatttgaaaggatgtgtatattttagtattttttttattgtaaaattaagggtttttttttttttttttttgagatagagttttattttgttgtttaggtttgagtgtagtggcgcgattttagtttattgtaattttcgttttttgggtttaagtgattttcgtgttttagttttttaagtatttgggattataggggtgtattattatatttggttaatttttgtatatatatatatatatatttagtagagatggggtttcgttatgttggttaggttggttttgaattttcgattttaggtgatttgtttgttttagttttttaaagtgttgggattataggtgtgagttattgcgtttggtttaagtttttaaaaattaaaaagaatggtatagtgtttttttgttttttaatagattaagattaaaagttttttttttattatagtttaaagttttaaagaaaggttatttaagttgttcgtttttttttgttttttttatgagtaatgtttttaagtgtgatttttgtagagaatagtagtgtttgattttatttttgaggggaatttttttgtttgtttttttttgagaaaaaatgtttgtgagttgtttggtaaatggatgcgttatttttgttgttgttgttgtcgttgtcgttttaaaggtttttggtgataaaggagtgaattgtattttcggggaaagtatgtcggaatttggtttagaaaagaggggtcgttgggggaagggtttggagatgacgtttttttaggaattttaaaagaaatttgtttatttgtttttggtatttatggtatcgttgatagtagtttaaggaaaaataaaaataagtttttatttgattgcggggttgattgtaaagtcgaaggattagagtggttagcgagtcgggcggttggatttggagttttggagaaagggttattggtttatttttgggtacgtacgtttacggaggtaagtttttattttttcgtgggtttttttttattttacgtggaaaaattgtgtacgttttaaattaaaagtagtttttgtttcgtttagagtcggtgaaagttgtttcgaaggcgtttgtagagtagggattggaaatgtttaatgtaaaagttaaatcgtgatagttgttttttaaatgatttgttaaattaaggattcgttaatatttgtgagtttatttttttgtattttttttatttttattttcgtttttttggtagaagggataaagatggtatttaaaaataatgtgaagcggttgttaaatcgagtgattttaaaaatatttttttttttttgaagtttagtgtggaaaattagattggatttgttagggatgtagatttatatagggtttatgtgtttggtttttttttttattttttagtataatggtttttattgttatttttttcgcgttttttttttttttataattatttattattttattttttgtgttttgatagttataagagtagtttttgtttttttgagttgagtagttgttaaatattttttagtagttagatttaacggttgggggggagaataggttaaattttggtattttttgttgtaaaagtgaaaaatatttttgtttgtagttaattttagtggtaagtagattatgttaattggatgtaattgtttttagatatggtcgagggttttgtgtgttgagatgaagggtttggtaagtgtttattttttgtgtaaattagtttattttatttagttttttattttggttagttttggattttgttattttgtttttattttttttttttttagtttgtagtttggtgtgagaagtcgtttgttatgtttttttaagtgtaatttttttgttatttggagttattttttttttggtttttgatgtgagtttgtttttaaataatgagaagggtttgaaaagatgttatttggattttaggttatttttcgttttttttttagtaaaggtagatttgaagagtattttttggttatgggggttgtattttggaatttagaattttttgttttttatgtattttttttttttattgttttttgattttcgatttttatttgggagaatatttttttttttttttaattagttcgatttttttttagtttgaattaagtacgttttagtgggttcgaaattttagaaaaaatgaaacggttgttgcgtagaggagaaggttgtggttatagaaaggagttgttttattagacgtgaagtcgttattttgttttgtaaagtaggttgtattttttgatatatttgtttttttttgtaagaaagggaggggaaattttatttaagagaattttttttaggtttttgtgggtttttagggttgtaattgaagaaaagtgttaagatttatgtttttttaaattttgtttttgttttgtggttagttttatatttttagtgttatttgtataagaggttgttgtttatttttttatattagttttattgataatttttgtggtttgtttaataatttatgaggagtagattatttgataaatgttagtttttttaatatgtaaagataaattgttggggttagggtgaggggtggtgtgttatgaaggaggggataggtggggagttaggatttttttttagtgggttggagaagtgtgaaagagtttgatgaaagaaaataggtagtttgttatatataatagttgtatttattatacggttgattagttttttgtttttatttatttttttttttttttatgtggatatgtagagtttttgagaatattttattaagtgggttgtttatgtttatattaatataagatgggaaagggtggaggttatttttgttttttaagtttttattttttttttttttggtcgttttttatttttataagttgttggttggtaagtaattgatgtttagaaaaatgatgtttatttgaaattttaaatgagtggattttttttattttttttgattttgtaggtgttttttgaagagttaaggagaaaagaaaatttttgattttattatttagttaataagttgtttgagaaataaataaaagagtttagattggttgttaaagttaggaatttagttgatagttttgttttgatgtttttgtaatgtttgcggatcgtagagggtgttatttagagtagggggtatttattgggatagatttattgggaagttgaaatagttagtttaaagtttaagagatgttaaagatagtgaaatatagtttaggaattgagggggagggggttttttatttaagaaggagattttttaggagggggcgggcgtggtattttttagggatagtatggaatgaagggaagaaggttggttttagaaggaggtattttgtgggaggttgagataggtgggttatttgaggttaggagtttgagattagtttggttaatatggtgaaatttagtttttattaaaaatataaaaattagttgggtggtaggtgtttgtaattttagttagtcgggggaggttgaggtaggaaaatcgtttgggattataggtgtttgtaattttagttagtcgggagaggttgaggtaggaaaattgtttgaaggaggcggaggttgtagtgagtttagattttgtcgttgtattttagtttaagattttgttttattaaaaaaaaaaaaagaagaagaagaagaaggaggtattttggatgaagatttaggttttagaatttattatttgtatgttttgggtaagtggtttagtttttttgagtttttgtttattttttttttgaaaatgattattttgtttatggtaatgaggataaaaaacgtgtaaagtgtatagtagagtgtaggtgtattgggtagatatgtatgattgcgttgtagttttgttatggttcggggagaaattatgaaaggaattagtgaaattttttgttttgggtattgttaaattgatgatagtattaattttgtgttagtagttagttggtgaaataataggtgaataatgttagtatattgtgaatataaaagtttttatttgtaaagtgttattgttgttttaaagaagttatatttttaataaatgattgtttaattttgtgatgttgttatagttttatagagtttgggaatgtttgggaattttttttgaagtgtgtgtcgtatttttttgttttgttttttgggagggtagatgtgattattggaaatggttaaaataatgtagtagtaaatttgttgattatagtgagtgataagtattgtcggttgttgtgtttgattcggaaggtagattttggaaggggtgtgtggggaaggtttgttggtttagtattggggtgagtgttggttttattttttaggtgggaagtggataaggttaaggggtttttgatttttagttattatggttggatttttagtgaggaaggagtcgttgttatggattgtttgggattgggaagattttttttaattgttgtaatgtttttgtatttgtggtttggttttttgtgagtttgggtttcggggcggtatttttgttgttaaaagaatagaaaagaaaataaaataaaataaaaaattaggattgttattgttagatgttggttgaggttagaaagaatggattgagttttgattttttatatttcggggagtagggaggtttgggaggtatagtggtttgagtttgaattttgattttgtttttttggaaggttttggaaggttaaaggagtttgtgtgtttaaattttagtttggtatttggtatatatttagtatgtatttttttttttttttttgataatgttttttgtttcgaatatttgaatagtggagagaggaatgtttgttttttttttttattgaattaatattcgtttatttattgagtttaagatttattttaggattgtttgttggattcggtttttttgtgatttaatagtgtaggggttttgtgttgagttgtatatgttcgttttcgttggtgttttttttttttttttttttttttttgtattatttatagtaaattatattagaatagagtgttaaagaggaaggatgagttatttttattgaaattattgatgatataaataaaagtaaaatgtttattatgtgttttgtgtagtatttaaggttaggttgtgttaatttgaatgtttttaaattggatttgtgaaagtatatatatgtgggaaaaaatttaggtttaattagagggaagttatttattgaaaatttattttagtatttgtttttttttttttatttattttagatttatatttatattatgtttgttgttttggttaacgagagggattggtttatttattagttaaggtttgtttattttcggaaggttgaggaatagtatagagaggttgtttaagtgtttttgtttttatttttttttttgttatttgttgaggaaggtattttttatttgttttgtaggcgtgggtttttaatgtgtttaagaattatagttagagttgaagggtttttggaattatttattgtagtatgtttatttgggaggagtaagtggaggtttagagaggttttgtgattttttttaggttatatagtaagttagaggtaaaattaggatttttatttttagtttattttaattttttttttataagtttgtttgtgattgtttaggtttgttttttgtttttattaaggggtaggtaagattagaatttgatttgagagtagttttagatttttgtttgtgagggatgttggggggtttttggtatggtgatttgttttttgggatatttattaatttttttgttgttgagtttgagtagattaatgtatattaattttttaggatttatagataatgttttatgttgggggttttgagatttaaagattgttaagatatgggatttttttttgaagagtttatattttgagttaaaatatgtatgttgatatttatgatagagaataggaaatggaaagattatgatatatatatttagagttgaaatgatttttgtttggagtgatttattttaaattttaaaattttgttgagtatttattgtttgttgggtatttgggtaggttttgggaatattgtgatgagtaagatagataagacgtttatttttttggggtttttttaatggggaagaaagatttttatttagttagtagttttgttcgtaattgtgtaagggtgattttgatatatgttgggagtttggatgaagtagtatatgagtaggatattaaaggataagtaggttttgaagacggggatagaaagaaggaaaattgtggttagggttaggggagaaaataaggagtaattttttttggtaggaatgagggtgatttatgttggaatggtaggttggggttagattgtggtgttataaatgcgtggagagagattagagaaggtagtatgaagaatggagagaaaatgagtttgaagttgagtagattcgggtttagatttttatgttgttatttgtaaattgtgtgatgttggttattaaggattgtgaattggttgggtgtagtggtttatatttgttattttagtgttttgggaggttaaggtaggaggattgcgtgaggttagaagtttgagattggtttgggtaatatagcgagacgatttttataaaaaaaaaaaaaaaattaaaaatgtagttgtgtatgtttataattttagtttttcgggtggttgaagagggaggatggtttgaatttataagtttaaggttgtggtgagttatgattacgttattgtattttagtttgggtaataaagtgagattttatttttattttaatataataataataataatagtaatatatattatgaattgtagtttttttatttttatagtgtagttattgtgtgggatagtttgaggatttggggtagtgtatttaatatattttgtatagtgtttgtaatagtgtagttgtttaataaatataattgttgtttgttttaattgttgtttttttttggattttatttcgggagagttggagttttggaaggtatttgaaaaggagagtgacgtgattggagtgttttatattgatgtgatatttattaggtatgtgtttgattgttttttgttttttttttgtttttacgagtttgtttgaaaaggagtttagtgcgtgattattagtttttaaggagattttttttttgtattttgtatttggtattttattaagatttgatgagaggatatgaaatggatttttgttatttttcggtgggcggggaagttgggagaggggtttggggagagggggtttttagttgttaggattaaaggaagtgatattttgaagttggtttgtcggattgttattcgtttttttaatttttttttaatagaaatttagtttttttttttgtttttttgatagtgaatagcgacgttatttttcgcgggttagtttcggttgtggtcgtagtattacgtaatgtttgtaaatcgatagtggtatggggagataagggttttaacgttgtgtaacgaggggtatgggttgtttgttcgagtggtttttggtttttgggtaattgttaattttaacggaggagcgggtcggttttggaaacgtcgttttagggtttttcgttggttttacggatgtttttttgtggttggataaaggaagtttatgtaggtcgtttatagcgtagtatggttttgggttacgggtgtttggttgttttgttttttttttttttttgttttttttaaaaaaagaagttgaaagggggatagttttgtttggtatttattatttttaatttaaaattaaataaaataaatagtttttaaatataaattaaattttaatttgtagtatagatattttttttttttgttcgaaatttattggttattggaggttagttttaagaaattggttttggagattttggtttgaaaaggagttatgtttatttgttttacgttttagtcgttggttttagggggtcgtggtagaatatatattgtattttagttgttttttttttttaagtttttttagttatttatagtttttttagatgagttgagttttagtattgtgtttttttttttttgtttttttagggtgatagaatttattattttgatatttggggttgttttgttttgttgtggtgggagatgggttggaagggatttcggaggttttttcgtgttttgtattatttagtttttttttggatttttttattttcgtagttaggagagggaagtaattgttttttgagtaggatattttatttttaaagtatttttgatgtcgttttttcgttttatcgt

SEQ ID NO: 40 - DNA, 26652 bp, Artificial Sequence
  chemically treated genomic DNA (Homo sapiens)
gcggtggggcgggggggcggtattaagaatattttgaaaatgaaatgttttgtttaaagaatagttattttttttttttggttgcgggggtggagggatttaaggggaagttgggtggtatagaatacgggagagttttcgaagttttttttagtttattttttattatagtagaatagggtaattttagatgttagggtagtggattttattattttaagagggtagaggggagagggtatagtgttagggtttagtttatttgaaagggttgtgggtggttgaggaagtttggaggggaaaggtagttgaagtataatatatgttttattacggttttttggagttagcgattgggacgtgagataagtgggtatggtttttttttaagttagagtttttaaaattaattttttaaagttagtttttagtggttagtgggtttcgggtagggaaggaggatgtttatattgtaggttgaagtttaatttatatttaggaattgtttgttttatttggttttgggttaaaggtggtaggtgttaagtaagattattttttttttaatttttttttttaaaaaagataaagaaaagagaaaaataaaataattaaatattcgtagtttaaggttatgttgcgttgtgggcggtttatatgagttttttttatttaattataaaaaggtattcgtggaattagcgaggggttttggaacggcgtttttaaggtcggttcgttttttcgttgaggttagtagttatttaggggttaggagttattcgggtaaatagtttatgtttttcgttatataacgttggggtttttatttttttatgttattgtcggtttgtagatattgcgtagtgttacgattatagtcgagattggttcgcgggagatagcgtcgttgtttattattagggaggtaagaggggagattgggtttttattaaaagagagttagagagacgggtaatagttcggtagattagttttagagtgttattttttttgattttgatagttgaagattttttttttttaggttttttttttagttttttcgtttatcgagaggtggtaagggtttattttatgtttttttattaaattttggtagagtgttaggtataagatataggggagaggtttttttaggagttgatgattacgtattaaatttttttttagataggttcgtgaaggtagggaaggagtagggggtagttagatatatgtttagtggatgttatattagtatggagtattttagttacgttatttttttttttaaatgttttttaaggttttaattttttcgggataaagtttaaaaagaaatagtagttaaaataaatagtagttatatttattgagtaattatattgttataggtattgtgtagagtgtgttaagtatattattttaaatttttaggttattttatataataattgtattgtaggaatgaagaagttatagtttatggtgtgtgttgttgttgttgttgttgttgtgttgaaatagagatagggttttattttgttgtttaggttggagtgtagtggcgtgattatagtttattatagttttgaatttataagtttaagttattttttttttttagttattcgagaagttgggattatgggtatgtatagttgtatttttaattttttttttttttttgtaaagatcgtttcgttatattgtttaagttagttttaaatttttggttttacgtaatttttttgttttggttttttaaagtattgggatgataggtgtgagttattgtatttagttagtttatagtttttgatggttaatattatatagtttgtaagtggtagtatgaaaatttgaattcgggtttgtttaattttaaatttattttttttttattttttatgttgttttttttaatttttttttacgtatttatagtattatagtttgattttagtttattattttagtatgaattatttttatttttgttaaagaaagttattttttgtttttttttttggttttgattataattttttttttttttgttttcgtttttaaaatttatttattttttaatattttatttatgtgttattttatttaggtttttaatatgtattaaaattatttttatatagttacggataggattgttagttaagtaaggattttttttttttattaggaaagttttaggagggtagacgttttgtttattttgtttattatagtatttttagggtttatttaggtgtttagtagatagtaagtgtttaataaggttttaaaatttaaaatgaattattttagatagaagttattttaattttgaatatatatattatagtttttttattttttattttttgttatagatattaatatatatattttaatttaaagtataagttttttaaggaaaagttttatgttttagtaatttttgggttttaaaatttttaatatagggtattgtttgtaaattttaaggagttgatgtatattagtttgtttaggtttagtagtagagaggttaatgagtgttttaggaggtaagttattatgttagaaattttttagtattttttatagataaagatttgaaattgtttttaagttagattttagttttgtttattttttggtagaagtagagaatagatttgggtagttataggtaggtttgtgaaggaagaattaaagtgggttgggagtgagggttttggttttgtttttagtttgttgtgtgatttagggaaaattatagaatttttttggatttttatttattttttttaaatgagtatgttgtaataaatgattttaagggttttttagttttgattgtgatttttggatatattgagagtttacgtttgtaaagtaggtggagagtgttttttttaataggtggtaagaggaggaatggagatagggatatttagataatttttttgtgttattttttaatttttcgaaaataaataaattttagttagtgaataagttagtttttttcgttagttagaataataagtatgatatgaatatggatttgaagtaaatagaagggagaaagtagatattgaaatggatttttaataaataatttttttttagttaaatttgaatttttttttatatatgtatgtttttatagatttagtttgggagtatttaaattagtataatttggttttaaatattgtataaaatatatagtaagtattttgtttttatttatgttattaatggttttaatgggaatgatttattttttttttttaatattttgttttaatatggtttattataaataatgtagagagagagagagagagagagggagtattagcgagagcgagtatgtgtagtttagtataaggtttttgtattgttaggttataaaagagtcgagtttaatagataattttaaggtgaattttgggtttagtggatgggcgagtgttggtttaatggagaggaaaagtaaatatttttttttttattatttaagtgttcggggtaaggaatattgttaggaaaggggaaaaaaatatatgttgagtatatgttaggtattaggttaagatttgaatatataagtttttttaattttttagagttttttaaagaggtagagttagaatttaaatttaggttattgtgttttttaggtttttttatttttcggggtgtagggggttaaaatttaatttattttttttagttttaattaatatttaatagtgatagttttggttttttgttttgttttgtttttttttttgtttttttaataatagaagtgtcgtttcggagtttaaatttataggaggttaaattataaatgtagaaatattatagtagttaaaaggagtttttttagttttaggtaatttatggtagcgattttttttttattgggagtttagttatagtagttggaaattaaaagttttttggttttgtttattttttatttaagaagtgaggttaatatttattttagtgttgagttaataagttttttttatatattttttttagaatttgtttttcgagttagatatagtagtcgatagtgtttattatttattatagttaatagatttgttattgtattattttgattatttttaatagttatatttatttttttaaaaggtaaagtaaaagaatgcggtatatattttagaaagaatttttaaatatttttaaattttgtggggttgtggtagtattataggattaagtaattatttattagaaatgtggtttttttagaatagtagtagtattttgtaaatggaaatttttatatttataatgtattaatattatttatttattattttattagttggttgttagtatagggttagtattattattaatttagtagtgtttaaaataaaagattttattggttttttttatagttttttttcgggttataatagggttatagcgtaattatatatgtttatttagtatatttgtattttgttatgtattttatacgttttttatttttattattatggataaggtggttatttttaaaagaaaagtaaataggggtttagagaagttaagttatttgtttaagatatatagatagtaaattttggagtttgagtttttatttagggtgtttttttttttttttttttttttttttttttttaatgagataaagttttgggttggagtgtaacggtaggatttgggtttattgtaattttcgttttttttaagtaatttttttgttttagtttttttcgattagttgggattataggtatttgtaattttaagcgatttttttgttttagtttttttcgattagttgggattataggtatttgttatttagttaatttttgtatttttagtagagattgggttttattatgttggttaggttggttttaaatttttgattttaggtgatttatttgttttagttttttatagggtgtttttttttaaagttaatttttttttttttattttatattgtttttagaaaatattacgttcgtttttttttagaaagttttttttttgagtgaggaatttttttttttttaatttttgggttgtattttattatttttagtattttttggattttgagttagttgttttaattttttagtgagtttgttttagtagatgttttttgttttaaatagtattttttgcgattcgtaaatattataaggatattaaaataaagttattagttgggtttttagttttagtagttagtttaaatttttttgtttgttttttagatagtttattgattaggtgatgaggttagaagtttttttttttttttggttttttaagaagtatttgtaaagttagggaaggtagaaaaagtttatttatttaagattttagatgaatattatttttttgagtattaattgtttattagttaataatttgtaggggtgggagacgattaagggagaaaaagatgggaatttaaaaagtaaagataatttttatttttttttattttgtattaatgtgggtataggtaatttatttgatgaaatgtttttagagattttgtatgtttatatgaaggaggagaaaagtaggtgagggtaggaagttgattaatcgtatgataaatgtagttgttgtatgtgataagttatttgtttttttttattaggtttttttatatttttttagtttattaaaagagggttttggttttttatttgtttttttttttataatatattattttttattttgattttaatagtttatttttgtatattggaaaaattggtatttattaagtaatttattttttataggttgttaaatagattataggggttattagtggggttgatataggaagataaatagtaattttttatgtaaatagtattaagaatgtgggattggttataggataaaagtagaatttaggagaatatgaattttaatatttttttttagttgtaattttggaaatttataggaatttggagaaggtttttttgggtgggatttttttttttttttttgtagggaggggtaggtgtgttaggaggtgtagtttgttttgtaaggtaaggtggcggttttacgtttgatgaggtaatttttttttgtggttataatttttttttttgcgtaatagtcgttttattttttttgagatttcggatttattggaacgtgtttagtttaggttgaggaggagtcggattaattgagagaaagagaaggtgtttttttaggtgagagtcgggggttagagggtagtaggaaaaaaaaatgtatagaaaataaggagttttgggttttaagatgtaatttttatgattaggagatgttttttagatttgtttttgttgggaaagaggcgggaggtggtttggggtttaggtggtatttttttaaattttttttattatttaagggtaaatttatattaagaattaagaggagagtggttttaagtgataaaagaattatatttagaggaatatagtaagcggttttttatattaggttgtaggttggggagggggaaaatgggagtagaatgatagaatttagggttggttagaatgaaagattgaatggaataggttaatttatataggaagtaagtatttattagattttttattttaatatataaaattttcggttatatttggaagtaattatatttagttaatatgatttgtttgttattaaaattaattgtaaatagaaatattttttatttttgtaataggggatgttaaggtttggtttatttttttttttagtcgttgaatttggttgttggggaatatttagtagttatttagtttaaaaaaataaaaattatttttgtagttgttaggatatagaaagtaaaatagtggataattatgaaggggggaaaggcgcgggagaggtggtaatgaaaattattgtgttagaaagtgaggaaaggggttaggtatatgggttttatataggtttgtatttttgataagtttagtttggttttttatattgaattttaaggaaagaaaaatgtttttagagttattcgatttagtagtcgttttatattgtttttaggtattatttttattttttttgttaagggggcgggggtgggggtggggggaatgtagggaggtagatttataaatgttagcggatttttaatttagtagattatttaggggataattgttacgatttaatttttgtattgaatatttttaatttttattttataaacgttttcgaagtagtttttatcggttttaagcggggtaagagttgtttttaatttgagacgtatatagtttttttacgtaaagtgaagagaagtttacgaggaggtgagaatttgttttcgtgagcgtgcgtgtttagaaatgagttagtggttttttttttaaaattttagatttagtcgttcgattcgttggttattttagtttttcggttttgtaattagtttcgtaattagataagaatttatttttatttttttttgaattgttgttaacgatgttataaatgttagagatagatggatagattttttttaaagtttttgaggaggcgttatttttaaattttttttttagcggttttttttttttgggttagatttcggtatgtttttttcgaaagtgtagtttatttttttgttattaggggtttttaaaacggtagcggtagtaatagtagtaaaagtaacgtatttatttgttagataatttataaatatttttttttaagaagaggtaggtagaaaagttttttttaagaatgaggttagatattgttgttttttgtaaaaattatatttagaaatattatttatgggagaaataaaagaaaacgaataatttaagtagtttttttttaggattttgggttatgatggggggaaaatttttggttttgatttgttaaagagtaaaaaagtattatgttattttttttaatttttaaaaatttaggttaggcgtagtggtttatatttataattttagtattttaggaggttgagataggtagattatttgaggtcgggagtttaagattagtttggttaatatggcgaaattttatttttattaaatatatatatatatatatataaaaattagttaggtgtggtggtgtatttttgtggttttaggtatttgggaggttgaggtacgagaattatttggatttaggaggcggaagttgtagtgagttgagatcgcgttattgtatttaagtttgggtaataaagtaggattttgttttaagaaaaaaagaaaaaaaatttttaattttataatggaaaaaatattgaagtatatatatttttttaagtatataatttgaggttatattattggtcggacgttgggttatgtattttttatatattatttatttaataatattgttttattattagtatgaattagaagttattaattttattttatagatgaggaagtgagtggtgaggaattttgttacggttatatagtttttaagagatagaagattaattcgaatttaggtttaattttagatataatgttttttagttttttattattttgtagttaataatcgtaggaaatttagatgttgtaagaatgtaagaaaaagaaaaaagaaaaggaatttttttatgaaatttatttatttttagtaatagtttttgttagtacgtgggggtttttttttttttttgattattttatatatatatgtatttaggtatatacgtttataatacggttttgttattgtatagtcgtttaggtatggaaacggttaagtcgtttttattgtataaattaaaagtttaaggttgtaatatattataatgattttttttttatatatgataagaattagagaggggttgaaattttaagtattttgtatagggttttttcggttcgtataggttatgtcgttagggttagggtcgcggatttttagcggtaatatttattttttgaataggataagtttttttgattataaagttaataggaattttttcgtacggcgagtttcggttgatagggttatttgttattggttacgtaggaggagagtattggtttttattagtgggttatgatgttaggtgttattaataaggtatatcggtaagaaataagagtttgttaagttgtttttttaattttggaagtaattaggtttgggtttcggtgttggggagggacgttttttaaagagatgggttgggggagttgagggttttgttatagtagattttagtagtatttaatttgttgaatagtttaaataaatttttaataatttttttatattttttttagttattataaaaagtttttttaaattaatattaataatggttgttttagtattgtgggttcgatggattacgttaagggttattatggtcggttatatttgttttttattatggtaaggagagtcgtgttaataggtttaatggtattaagattataacgttgagttaatttatttagagtataacgtcgggtgagggtggtagggggtttagcggtttttttgttaggttggggttatgagagaagtaggaagtagggaggtggttttatattttgtgtgttttaggttataagtgattttattaatatattttaaaaattatattgagaggtaggggttaattttattttatagaagaggatattgttgttttatagaggtgaagttatttgtttaaatttattatggagtattagtatttaaatttaagtttattagacgttagtttttttgtttttgtagtgttattttattttttattaagacgatggtttggtggtatatttgatttgtttttagtaagtttggtggtggtggtttatgtgcgtgtatatgttttttttttttatttttgggggaatcgaatggttttaaagaggaaagaattttaaaaattattttaaatggtttagaatgttttttttttattaaaatgtttgtgatagttttttaataatttttttagtaatattttagtgttttaggaagtttttttttttatttaatttggattttttttattgtaatgttgaatataatttgtttatatcgaagaaaattaggtttcgaggatatagttgaaagtgagttaggaatttagaattaaggtttttttaagtatttagcggaagtttttatgttgataataaagtatcggattttttttttgtagttgtagagataagttttacgtaggtaaaatttaattatagtttttttagattgtattagtataataaggatatcggggtttttaaggggaaatagtagaaaggggaatttttgattatgttggtatgaaattaatagtatgggatttttatttttgtaaatgggttttttttttttttttttttttgttttttaagttagtataaaaggtttttattattagaagttgatttttttgtgttggtaagagatgacgtattagtttttggatttatgcggtttgggtttttaaagagttgaattttttgtagtaattttttttttcgtaagaagttattagaggaattgaggaggttagagttggtgaagttatgagttttttggttatttagttgtagagagtatggagttagaagatttgaatataaattttggtataatttttttttttttttttttttttttgagatagttttatttttttgtttaggttggagtgtagtgagtggtatgatttcggtttattgtaagttttgtttttcgggtttacgttatttttttgttttagtttttcgagtagttgggattataggcgttttttattacgttcggttaattttttgtatttttagtagagacggggttttattgtgttagttaggatggtttcgattttttgatttcgtgattcgttcgtttcggttttttaaagtgttgggattataggtatgagttattgcgttcggtttgtataattttttattagagaaaagtttattaattttttgggttttttttcgtttatttgagaatgtgaaattgatatttattttataggatagttagaggttttatagagatgttggttgtgagtgtatttagtatagaatttgatatgtagtaagtatttaaaataatgtttgttgagtttatattttagaagtattttgtattgataggtaggaaagggaaggagttttggaatttttaatatttataagtttagttttaggatttttattagtaaggtggtatttgtgttttttattttttttataagtatagtgatgtgtacgtttggttacgtgtataggtaataggatatcgtattagtgagttttttcggtatttggattcgatggtagtggagcgttgttcggttaaatttaaacgagaattggaatgatttattaggttttaggttaatgggataaagagtattttggttattatagtataagagattagtttttggggaagacgtagaagtaatgttttagttttaaatatgaggtgttcgaggtagtagttttatagtattgtacggattgacgtttatgcggaagaacggttttagggagaaagtaggatttggattaatatgaatatattttttattttgtatggttagtatgatttattttatataatgataagaaaaatattttagtaaatatttatggagtatttattttgtgttatcgttttttatataggataaatattttttgatgaatttttataataatttaatgaagtaggtattattattatttttgttttataaatgagtaaataggtatatagaagttaagtaatataattattgttatagttagtaagtagtaaaattagaagtttgatttggatagttaaagtgtttattttttatttgtaaaacgtgggggtggggaagagttgtagtaaattttttattatttaaataattgttagagagtaagagtttttattttatatatttagttaaaatagaatagaaaatttttagttatggaaaatttagaaattttttaatggataaattgaggtatatttgtatttatttagtaagattttaagttatatatatttgggtttttagtagggtttgttttaaattaataaaaaaaattaaagtgattggaaaagttttttttttgaattagtaagaaattaaagagttgtgaatagaatttgattttaatagtttaggataattattattttaaagatttataatagtttttttagaacgagtaggaggaaaacgtgttgttaaattatagtttttttttttttagtaattagcggttttatttaatagtgatggtaaattaaaatgggattttttattgagatgaaagagtgggtaatttttttttattgaaaataaaataaaggaaattatttttaaaagttttaagagtttagtttagattttagatggtttagtaattttaagtaggttaaagtattttaaaaaaaaaaaaaaagttagaatatatagaattaaattaaattgattttttatttaattggttgaattgttaatttagattttaaaatagtaaaatttaattaattaaaaggattttatgaagatataagtgggtatataaagaataaaagaattttttaaagagcgtaataatttagaaagagtttattgaagtgtttagttttaaaaatgaagaagttaaggtttacgatgaaaaaaacgatgttaatggtgatagagttgaaaaacgtagagttaggtttagatttggttttattattataaagttttttgttatttttttatttttataattaataatttttttttaaaagattagatttttaggagtttaggagattataaatttgttatttattatttttaaaaaggatattttttggaaatggaaatggatttaaaaaggattttggtaaatttgtgaatgataaggtagttataaatagttattaagagaagttatatttgatttttaggattgacgttaaggaagatggttgtagtttttaatggtggtattttaggtatggtgatggtaattaaagattaggttagatggatttgatttagaagagtaatgtttatgtttttatatggtttggtgtagagcgtttaggattgtgaattagaaggtaagttgagtgtttggttttatttatttatagttgtgtgattatgggaagttatttatttgttttaaattttattttttttatttgttaatagagaatgataatcgtttataattttttatttaaaatttttaggtgttttaacgattaaaattgtttagattttagaaaggtattttgggtcgggcgcggtggtttacgtttgtaattttagtattttgggaggtcgaggcgggtggattatgaggttaggagatcgagattattttggttaataaggtgaaatttcgtttttattaaaaatataaaaaattagtcgggcgcggtggcgggcgtttgtagttttagttattcgggaggttgaggtaggagaatggcgtgaattcgggaagcggagtttgtagtgagtcgagattgcgttattgtagttcgtagttcgatttgggcgatagagcgagatttcgttttaaaaaaaaaaaaaaaaaaaaaaaaagaaaggtattttgatatttatcgtgtttaatagttttagtagagtttagggtagtattttgtaattaaatatattaatatttttgtagtaaaatatatgaatatttaaattaagtaggataaatatagttttatattagtttagattaggttttgttattaaatgagtttattgtaaattttttagtttttagagttttttagattttattattatagatatgggattatggatttgtatttatttaaggaaggttgtgagggtaagagagataaagttattagaggtgttttgtaaagaagaaaatgttgtaatcgataaaaggtattattaatattattgttgtggttattattattttatagtatatttttttttaaatagaatttagtttgatattagaggttttggacgggatgatgaaagaaaattaagagttttaggaaattttaaaaattttaaaagtagtttaaattaaggttaatatttgttggttttttatatgattaattattaaaaatagagtagttgattatttgagagagattaaggttaagggttaggtagaattttgatattttagttataaagtttatgtatcgtatagttggttttataaagtttttgggaagggttgtatatacggatttagaaagttggtttagatattttttgtggtttttgagaatttttttaagaattaggtaataggtcgggcgtggtggtttatatttgtaattttagtattttgggaggtcgaggtaggtggattacgagtttaggagatcgagattatattggttaatacggtgaaattttgtttttattaaaaatataaaaaattagtcgggcgtggtggcgggtgtttgtagttttaattatttgggaggttgaggtaggagaatagcgtgaatttgggaggtagagtttgtagtgagttgagatcgcgttattgtattttagtttgggagatagagcgagattttatttttaaaaataaaaaggaattaggtaagagttgcgacggtgtttgtgtaggatatttattgtagttgatttaagtgtttgtttgtataagatttagaaattagattttattgtgtttttgtagtattaaatttagaaatatataaagattaagttgcgtgagttatgggagattagggattataaatgaggattatgtttatatttaagtttatagaattatattgttttttgtaattttatcgtatatgtacgtaattttgagaatgattaggtgtttttggtttggatgagttggtttttagattatttttagagaagtttatatgtagaattgttttagttttttggaataagaaagggagggtttagtgttttagaattttgagatgattttttttttttttaggtattattttttgtaatgtggatgtattggtgaagatttgggggtttaaagtttgtttttttatttgtttgtagaatattgtttatttattagatttttttattgttttgatttttttttggtttgtttaggtaagttagttttattggatgtttttgtttggtttttttatttatttatgattatatttgatattgtattttttttatagtacgttatttttgtagtggacggtttgtatattttgttgttcgttgtaggaaataggttttataattttattaagtttgatttttattatttgttgagttaatagtttattttttattttatattagtttgggattaaattatggggaaatttatcgatgatattttataataaattttttgtttttttgttttatttattagtaattcgtttttattttttttttatttttttttgtttttttattttaagaagaaatgtaagaaggattgttgggtatttagtttttattaatatttaggtttattgatttaaaaataaaataaaataaattttgtagtttgttattttattattgatatatttttagtgaatgttatggttttttggttttaaaatttttttttttgattttttttttttttttgttttggttttttgtttgtattggttatagggttgttgtttttttttttttattatagtattttttagattgttgatgggttggggggagatagagaatagtagaaaaaagggaatagtatattaattttggagttttgagggtgagggggagaaaaaaagttttttataaagtatatttagttgggattcgaggggttgttgatttgagtgagggttgagtatacgtaggattatttttttttttttttgatttttttagatttttaagttttttattaaaggtattgtttttggttttaattttttgggttgtagttgttgattttttatttttagttaaaagtatattttcggtttagtagggtggtatatatttataattttagtattatgggaggtcgagataggtggattatttaaggttaggagttttaggttagtttgattaatatggtgaaattttatttttattaaaaatataaaaattagtcgggtatggtggtatatatttgtagttttagttgtttaggaggttgaggtaggagaattatttgaattcgggaagtagaggttgtagtgagttaagattatgttattgtattgtagtttgggcgatagagtaagattttgttttaataataataataataataaaagtatattttttttgttagtagtttatatgtgatacggaggattttagggttagtgttttgttgttatatgtttataaggatagggatattttttgtattattttatagttaatataatttttatggagggtggtattgtggatattatatattagaatttagagttaatgaggattatgtagagatgaggtttaaataatataagggatagatggttagttttttatcgttgcggtgattatgtgtttattatagttttagtgatttttggattttattttattaatttagtattaattttgttgatcgtttttattttaagaagtgagtgaaggtcgggcggggtggtttatagttgtaattttagtattttgggaggtcgaggtggatggatcgtaaggttaagagatcgagattattttggttaatatggtgaaattttgtttttattaaaaatataaaaaattagttgggcggggtgataggtgtttgtagttttagttatttaggaggttgaggtaggagaatcgtttgaattcgggaggtggagattgtagtgagttgagattacgttattgtattttagttcggtgatagagcgagatttcgttttaaaaaaaaaaaaaaaaaaaaatgtagtgagtgaaataaggtttagaaaggttaaataagtattataggtttttattattaaatatggttaattttaatatttaggttttttcgaatataatatggttaattttttttttttttttagaggaatgagggttttgttgaaggggaatttggaagttttaggagagtggtattttttgtggttttttcgggtaaagaaaagtaattaggaattaggatttgatgagagttagaaaaataattattttttattatatttagtttttatagtatatagtcgaaataatttatattcggaaagatgatatatttatttggttaattttggggagcgggttttttttttaggaaagtttgagtaaaaataaatataattttagtttatttttgagcggtataagtattaagaagatatattttagtggcggttatttttcgtatttattggaaaaagtcggttacgtttagttttgttatattttttataagttaagtttttgagttgtcgaggaggtagggttagagtagatttcggttaggggtgatgagattaatttttagatatttttattttaattttttttatttatatttttcgtatttgaacgagtaataggggaatgggggtgaagggggaggaagtggagaatttatttaagattagtaaaatagtagattatagggtatgtagttaaatgttgtcgttaatgataatagaaagttggattttttgattttatttatttgatttagaaattagaggataaaatgatgggtacgtggtttatgatagaagtaaggaaaaaaaaaataaattcgttatttattttttttgttatttattttattttttataagtaatttttaaaacgttttgttttatagatatgattttttttaagtttaagtgattttaagaggtagtaaagtattagggggtaaggatttaaatttgaatttagttttgttttttattatttatgtgattttagaaaagagatttgatatttgagttttagtattgttttatgtaaaagaaggatattattagttggatacggtggtttatatttgtaatttagtattttgggaggtcgaagtaggtcgattatttgaggtcgggagttcgagattattttgattaatacggtgaaagttcgtttttattaaaaatttaaaattagttaggtatggtggtgcgtgtttgtaattcgagttattcgggaggttgaggtaggagaattattttaattcgggatgtagaggttgcggtgagtagagattatattattgtattttagtttgggtaaggagagcgaaattttatatttaaaaaaaaaagaaggatattatttattttaaagggttgttgtaatgaaaatgtaatttatggaaagtgtttagtattgaattaaatatgttataagagtttaatgaatggttattttatagagaaggaaacggaagtcggagggaagttaatgttagtttgaagcggtatttagtttagtgtgagtagagatgggataagaatgagattttataggttgtaagattaagatttttatatttattttttttttttgtatttaaattaattttttttaaatgtatgtgtaggattagagaatgagaagggagatagagtaaggagattaatttttattaggaataaggtttagaatttgtagttgtttttgtggtttaagtagtttttagatttttttatttttttaagttgtagaaagggataggttgtttttatagggattattgtatgggaattcgaggatttgaaatttagtaatatggttagatgtagggtttaagagatttttattttattttttttttttttttttttattttattagttattttaagtaaaggagaatagattaaatagtcgaaaaaataaataggggtttaaaagtaaaaaataaagggaagggtttattaagaagttgcgtttatgagtgttttttggtgttttttggaaagattttaggtttttttattatattttaaaaaatttgttttttttttcgttagaattttagaagaagtgttttggtttttttataaattgttaagataggggagttaggtttttaatttgggagtagttagggtgtgaaggaggggtgtgagggttttaagttttatattaggtgcggggttggagcggggtttatttgtgttgttttatagtttcgttattaggaagttcgattttatatacgttgtattgtttttcgatggttcggttttttgattttatgtttatagttagtttttttagtttgttgaatagttttttttggatgaagttttggggtagtagttttttataggtgttgaagtttatggagatagttagggtaggttgtacgtggaggttagaggttacggaagacggtatgtttaatatagcgttagttttgtggttgggtaatacggagtagatgtttagatgttttttaggcgggggtgttgggtgtttaggtcggttagtgggggtttggttagttttagttgggggtggtatttgttcggtatttttttttcgtttatagtgtagttttttagtattggtgatgacgttgtttcgagtcggggttttaggtttttttttgtttttttttttaattttgttttttattttttttgagatgttggattcggttgttttagggttgttttggttgggtattttatttatttgtattattttcgtttttattttagttattttagggtgtcgtttatttttagttagagttggtttttcgggttttgtaggtggttgaagagttttttgtaggagagattgttttatggttattaaattgtttattgtagttttggtgggatttatggttgaaagattaaatgaagtggagattgaagggttttggtttattatgggtttagggaggttttgtttagttatattggtatatttatttttttcgttggaatgtttcgagatgaagatgtttttgaggtatcgagttttgcggtttttttttttttcggtttcgttatcggttatggtggttttcgtgttattgtcgtttgaggtttggatggtttttagtatttttaggtattgtttttttaggtattcgatttttaggatttcggtcgtatatagtaggttatttaggtttttcgttttggtttgtagcgtggttgtatatgtatattttagaatttgttggaaggtttttggcgagaggaagtttaaagtatagtgttgattattgcggtggaagaggattttaaatattttgttggtgtaggttagtatcgttcggtgggcgtggaatttttggttgtttattatgatgattatatcgtataaagtttcggttagtcgtatttggttggttttgtatagtagtttcgtggggtggttagggttttgtagttggattatgtttatttttgttagatttatggtgtttttttcggtttaggtatgaggttttttttttttttgggttttgcgtggcggggttgggtgggttttttgggttaatagaggaggttaggagaaagaagaggggaagaagtaaaagagatgagagaataaaagataaatttattagtgtttttaaaagtaagaatttaattattataatatgtttttttttttttgttgttaagtttttagtaagaggattttagagattttaattgaagtagttttttagaaatttataaatttgttttttaagttagggatgttgagagtaaaaagaaggttttgttatagtagatgtttaatttattattttatgatatttgttagatgaagtgaaatgaaaattgtagtgaagttttataagtttttagttttttttgtgtttgagagtaggggttttttaggtaaggttaatatttattatgatgaagtgtatttatttaaaattagtaagattttagttttttttttgttagttttacgttagttttttggatgttaagttttatttttaaatagtttttttaaattttgttttattataggagttttagaagtagagttaaatttattggaggttaggagtttgtagttatggttatagaaatttatggatattgggttttttttcgtaaaggttatttttttattattagttttggtttttggttttttattgtttttagggttgtaaagtattggtagatttaaggtttgtttttatttttaggtattaataggaatatatataatttatatattaatttgggttatttttatttacggaagttttaaagttattgtatgtataatataaaatttgaattgtgtgtatgtatattagttagagatagatagaaagagtgtgtggggtagggcgcggtggtttacgtttttaattttagtattttgggaggtttaggtaggcggattatttgaggtcgggagttcgagattagtttgattaatatggagaagtttcgtttttataaaaaatataaaattagttaggcgcggtggtattcgtttgtaattttagttattcgggaggttgaggtaggagaattatttgaaatcgggaggcggaggttgtcgtgagtcgagattgtgttattgtattttagtttgggtaataggagtaaaatttcgttttagaaaaaaaaaaaaaagtgtgtgtgtgtttatatatatatatttacgtaaggtgtcgtatttatttttttgtttataattgttcggtggataggaggatttaaaaaacgaagaaggatgggttattaaggtatggagagagattatagttaaatatggttttttatagttaggagtgtttatgttgggttgggtgtgtgaattttacgtgtgttttataggttttaaggagtttgtaagttttgtgattaggggtagtaagggatgttggatatggtttagaggcgttggaagtgatattggtattagtatttgtggtgtgagttataattagtacgaagggaagatagggttgggaaataaaggttttttttagagtttgttcgggattaataagagggtttttagattttaaatttcgtttataggagtgttagaaagatcgcgtaggtttaggatttttttcgtgtttgttttatagcgattaatattgtagtgaatgtattgagagtaaggaatagtaaggttttttttttatttttcgaatattgtttgtttgtttttatttttagaaggagttttattagtttaggagttattaagtttacgtagaaaggatttataggacggttggttaagatatttttgttgttcgtttcggggtggggacggaggtcgttaaggttgggatgagtatttagtcgagtcgagttatcgcgtgttttttcgtagatatcggggtttttgagaattaggagggaatagttaaaagaatggaagtttggcgttttgaaataagttttttgggttttgagggaaatttgggcgtttacgggtagtcgttttttttattcgtcgttcggcgttcgcgattcggttggcgttggttgtagcgtttagttaggcggcgcggggaagagtcggcgataattcgttcgagtttcggggatcgatcgcgtttttatatttttttagtttttagcgatttttatcgagatttggagacgattttagtaaatttggggaagtaatttttttcgaggagttagatttttgaaagaaggagagttgagttagggacgagggaaagcgaaagagacggggaggaacggcgatagttcgggcgggttggatttcgcggcgagagcggtaggggaggcggattcgtttcgcggcgaaggggaagtataaaagtttcgtagcgagttgtgggaggaaaggcgagaaggggtttgttcgtttttttttttcgatttagggtcgtgattttttgggagcgatcggttgggttttaggtttttggttagcggcgttagcggttagcgcgttcggtttaagtacggtgcgagcgtttcggggaggcggcgagcgagtcggtgcggagcgtttcgtgcgttcgggtggtttcgcgggtcggcgggatcgtgcgtattttaagcgcgtgcgggagtgtgcgaggcgttgtgcgagttagcggcgggcgcgttagggtgggaaaggtatttcgaacgtattaggtgtagagatcggtatttatcgagagcggtcgggagcgtacggcgagtttcggtgttatcgtcggtttcgtcgagagtcgaggagggttcgtagcgttgtagattttttggagttttttttttttttttgtaaaaggggggtggggattaagtttaattaagaaaaagtttattacgtttttttaaagagaaataaaacgtaagtagttttagttttgttttttttcgtttttagatttattcgttagttttttcgattttagttttttagtcggtcggcgaataaatatataaataaataaattataattttattttgcgttcgcgtatcggttcgtatatataagagtatttacgggttttgttgtttcgttagtttttggcggtataaagttttcggattttcgatttttttgtttacgtttttagttttcgtatatcgttacgttttttattttttatttcgatcgtgttttgaagaggaagggttggggaggtagttgcgtttaggttgatagtcggggtttttttttttagtcgatttttaatcggtggcggcgacggttgtagcggtaggaagggaatacgttaaataaaaaaggtataagtttagcggtcgagtggtcgaagcgagcgcgcgttttttagatttttttagtttcgggaagtttcggcgcgcggcgttcgttgggcggtgcgttttttttcggttttttatttatcgtagtcgagtcgggtattgtggggtgggtgtgcgtgtttgtcggggggtgtgtgtttgtgtcggggaggggtgttgttggggaattgttgtttttcgtattacggcggtagcgatagtatcgttcggtagttcgtagtattcgtttttatcgtttttaatttttttttgttgcgaggttagtaaattattatcggttgttgcgttttcgtcgcgttttacgttaacgtcgagtttttttttttgtaaggtttcggcgtttttttatttttagtgttggcggtcgagttcggttttttgtttatagttgtttttttttttttttttttttcgcgtcgttttcgggtttagttcgtttattatttcgtattggtcgagttcgcgcgcgtttttcgttttattttttttttttttttttttttttttttttttttttttcgcgtttcgcgtttcgggtttcgtttgatatttagttgttgttggggcgtcggcggtcgttttttatcggtcgagcggagaggaaggaaggagttagaggataggagtgtatggggatttagaatttttaataggggaattgagggtgaagggcgcgtagtagtttttatttatttttaagattttaatttgtattggatacgggttttgttttttttttttcgtatttcggtgtttaagtacgtagttttgtttttttttttaatgtttgttttaatttagtgcgtgttatttcgtttttaattttttttttatggttcggggttgtagtttttttgatatttgttttaaaaggtcgtttttttagtttaaattcggtttttttatttttttggttattgcgcgtttttcggtttgagtattcggattttaataagtttttcgaggtagagttcgcgggcgttagtgaattaggtgttagaaggttcgcggggatttattgtcgaagcgagatattcgtttttagttgtcgcgattgttggaggttaaggtcgagttttgggagaaattttttttttttttaaattttggatagtttttcggttttgtttttattttattttttcgttttttagtaatttgggtggaaatagttttcgagaattgcgtttagtttagtgtatagtttttagggggtagggggaagtttggataatttttgggttttttaaaagtgtgtttttttttagttggtcgttttattttagagggtagagtagttaaagaaaatgtattttttttttgattgtagaaagttgttttttttttttttttttggagttgagcgaaggtagggtgttagaggcgggaagcgtttttcgggtacgggttgtggattttgatcgaagtttaggaggttggggtgggaggtgggggtggtcgagagcgttatttagggtttttaggttagttagttttcgaggttacgcggttttagtaatgcggagtttatgttattaaggtttgagtttgtatgttttgttcgtgatttacgggtgggttagaggtttttcgtaggatttatttagaattatatttttatgcgtgtttttggtattgttttagatttagttttatgaattgtagggttatggaaggtggtagaaatttgtatttgttcgttgaaggttaggcggtagagtttatatatcggaattgattcgggtttataagagtcgtttatgaggtagttttaaagacgggttattttattttagtaagagttatttttgatttttaagagtagggaaagtttagtttagtaggagtttgcggagagagttgggtaggggaatatatttgagtgaaggaagggtttttttgatagtacgggatataattatattaaatttagggtaagcggaggggaagtttagtttttgggtatttattttattaataataaagagtaattttatttagagattatttgtttttttaattaaggtttatatattttgttagaggaaagggatttaaagaaagttaggaaagaattgggttgtaaggagagtaagagtggagggatgtaaggagaggagaaaagatttttttggtgttttattagggaaatagaagaaagaattattatatttgttgagtttttgtttagatagtgtttgttggaggttttcgttttgttgtttatatttatttattagtttttttttagtgtagtagtaggagaagtatataattaatttttgattttaattttttattaatttttaaattagagaaagagagaatttttggaaataatgggagagaaagtataattttttatggttttggtttttttattttcgtgttatatttattttatgtgaaaattttttttgttttataaacgttgtttattaaaagtttagtttttgttagtaagtgttaaagagagattaatgtttgaatttaagaggtggagaaggtaataaaaaggaagaaggtaggcgaggttgtgggttgaatgttagtattgggttttaagtatttttatttagcgttgaaggttggttgtatagtagtttgataaggtttattgggtttagataaagtagtagtagtttttttattaaaattggtattatttatagttagagttatgtttttgggttttgggaaggttgatgagaatttttagtttagagattttatatggtagtatttaaaaataagtaggatggaaaattataagagaatatttaatttttttcgcgcgtatatgttcgt

SEQ ID NO: 41 - DNA, 2573 bp, Artificial Sequence
  chemically treated genomic DNA (Homo sapiens)
acgaaaggatagtagaaatagttttataattttattttttaggaataatttttatggatattttgttgtgtgtttattgtttttttaatatatatattttttaattaaatggaattgttttaaatatgttatttaatagtttgtttttttttatattatttgaaaattaagaaacgattataatatgttttatttaaaaattttaagtttaggtcgggtatagtggtttacgtatgtaattttagtatttggagggatcgaggtgggcggattataaggttaggagattgagattattttggttagtatggtgaaatttcgtttttattaaaaatataaaatttagttgggtatgatggtacgtgtttgtagttttagttatttgggaggttgaggtaggagaatcgtttgaattcgggaggtggaggttgtagtgagcggagattgtattattgtattcgtttggtgatagagtaagattttattttaaaaaataaataaagaaaatttgaagtatagtatttttttaaattttaaatagataatagaaattggtttttttttatttaaattagaatttaagtttaattttatatatttttgatagtttggattttgttttttaattttataaaattgggaatttaagtattatttggttcgatttaaatgtaatgtagaatttgtattaaaatattatattaaagttttagatttgtagtagttaatagtatttttatgtatgtgttagggattgttttaaatattttatatatattaatttttttattttgtatttttgttttcgttttatatagtaggaaattgaaatattgagaggttaagtaattaaagttatagagttagagtgataggagtaaagttttaatttaggtaatttagatttttagagttttgatttttattattaagttgttagtatagtttttttggtaattatttttaatttaaatataattcgagtgatttatttaataagttattattttgataatttagtgatttgtaatgtaaaattatttattgtaatttatttaatattattgtttttttgtgttgtaaaaattatagtaatcgagatgtaatttattatttttttttttattttcggtattttgtgttaatttttttgttttgcggatttttttcgattttttattatgcgtgttaattgttattaatttttttgtttgttggggattggggtcgcgagggtatattttcgaggggtacggggttagggttaggtaggttgtgcggttgggcggggttttgtgttttattgcggagtgcgggtcgggaagcggagagagaagtagttgtgtaattcgttggatgcggattagggcgttttttattttcgtcgggagttcgtcgattggttgggtgtgggcgtacgtgatcgatatgtggttgtattggtgtagttcgttagggtgttattggagatagaatggaggtgttgtcggattcggaaatggggtaggtgttggagttattatggttaggtttgttgcggggggaggggggaaggtggttttttttcgtattgttttaaatcgatggtttttttttggtatagggtttattgtagtatgttaaacgaggaggtaggggcgtcgttttttcgttttttattgtagtattggagatggattttttgtatttcggatttagggtttttgatagaagaggaagaagggggaggggtagaagtgttaaggggagtttgttgagaaaagttgtttttgaagttagaaggggtttttgtttttataatgttatttgatagagtggaataatagtatttaaggaaacgggtagaggataataaagaatggagtatatttatggcgaggagtaaaagttttattttattgaaaggtttttttttttttttggcgataaggatatatgtattggtggttaaaagagagaggagataaaatcgttgtagatggttgatgtgaatttagtggaaagagttattggggatgagagaaagaggaggaggtaggtattgtagagcgtgagtggtggtgttggttggtgaaatattggttattagtagtgtgtttgtttttgtaaaatatttaagtaaattttttgtgaatagggtggtaaatagatattagtgtttttgttagttataaaatgtagtggtagtggttttttgcggacgattgtagtagtgttttttttttttttgttaggtcgaaaagataattgtagaggaataagaaattttgtagtaaatgttggggtagaagtttatttataagaagttatagtttataaatgtagtttgaatagtagaaaaaaaattattgttttttaaagtaggaataatgttaggttatgaatgttttgttattggaatgtattggatattttgattttatattacgaaagtgatgtttaaattttttgatttaatataaattttatacgaaattttaataaattatgtatgaaatagtggatttttttttttgttagtgaagtttttatgttattaattaggttatttaagagtaaattattttataacg

SEQ ID NO: 42 - DNA, 2573 bp, Artificial Sequence
  chemically treated genomic DNA (Homo sapiens)
cgttgtaaagtggtttgtttttgaatgatttaattaatggtataaaagttttattaataaaagaaaagatttattgttttatatataatttattaagatttcgtataggatttatgttaaattaaagaatttgagtattattttcgtgatgtagaattaaagtgtttaatatattttaatgataaaatatttatagtttgatattatttttattttaaaaaatagtaattttttttttgttgtttaggttgtatttataaattatggttttttgtaaatgggtttttattttagtatttgttgtaaggttttttatttttttgtagttgttttttcggtttaatagagggagaaaaagtattgttgtagtcgttcgtaaaaagttattattattgtattttgtaattaataaagatattggtatttgtttgttattttgtttatagggagtttatttagatgttttataaaagtaggtatattattggtgattagtattttattaattaatattattatttacgttttgtagtatttgttttttttttttttttttatttttagtagttttttttattagatttatattagttatttgtagcggttttgtttttttttttttttggttattaatgtatgtgtttttgtcgttagggaggaaaagaagttttttaatggggtagagtttttgtttttcgttatgaatatgttttattttttgttgttttttattcgtttttttagatattgttattttattttgttaaatggtattataaaaataaaaattttttttggttttaaaaatagttttttttagtagattttttttaatatttttatttttttttttttttttttttttgttaaaaattttggattcgaagtataggaaatttatttttagtgttgtagtggggggcggggggacgacgtttttgttttttcgtttggtatgttgtagtggattttgtgttaaggaaaggttatcggtttaagatagtgcgagggaaaattattttttttttttttttcgtagtaagtttggttatggtggttttagtatttattttattttcgagttcggtagtatttttattttgtttttagtgatattttggcgggttgtattaatatagttatatgtcggttacgtgcgtttatatttagttaatcggcgggttttcgacgggaatggggagcgttttggttcgtatttagcggattatatagttgttttttttttcgtttttcgattcgtatttcgtagtggggtatagggtttcgtttaatcgtatagtttgtttagttttagtttcgtatttttcgggggtatgttttcgcggttttagtttttagtaagtaaggaagttgatggtagttgatacgtatagtaaagagtcgggggaggttcgtagggtagaaggattagtataagatgtcggaggtgggagggagagtaataaattatatttcgattgttatgatttttgtagtatagagaaataataatattaaatgaattataatgaataattttatattataagttattgagttgttagagtgatgatttgttagatagattattcgaattatatttgaattaaaaatagttattagaaaagttatgttagtagtttagtagtggagattagaattttggaagtttgggttgtttgagttgaagttttatttttgttattttagttttgtaattttagttatttaattttttagtgttttaattttttgttgtataaaacgggaatagaagtatagaatagaggagttaatatatatgaagtatttagagtagtttttgatatatatatagaagtgttgttagttattataaatttgaggttttaatgtagtattttaatgtaaattttatattgtatttaaatcgaattaggtgatgtttaaatttttaattttatgaggttgaaggataaaatttaaattgttaagaatatataaagttaaatttaaattttggtttaaatggggggaaattagtttttattatttatttaaaatttaaaaggatattatattttaagttttttttgtttgttttttgagatagagttttgttttgttattaggcgagtgtagtggtgtaattttcgtttattgtaatttttatttttcgggtttaagcgatttttttgttttagttttttaagtagttgggattataggtacgtgttattatgtttagttaagttttgtatttttagtagagacggggttttattatgttggttaggatggttttaattttttgattttgtgattcgtttatttcggtttttttaagtattgggattatatgcgtgagttattgtgttcggtttaaatttaaagtttttaaatgaagtatattataatcgttttttaatttttaaatagtatgaaaagaagtaagttattaaatagtatatttgaggtaattttatttgattaaaaaatgtatatattagaaaagtaatagatatataataaaatgtttatagaggttatttttggaaagtgagattatggagttatttttgttgttttttcgt

SEQ ID NO: 43 - DNA, 4160 bp, Artificial Sequence
  chemically treated genomic DNA (Homo sapiens)
gcggttgaggggggaggattacgtgagtttaggagttttaggttatagtgaattatgattatgtcgttgtattttagtttgggtgataaagtgagaatttgtttttaaaaaaagagagattgataaagttttttgtttatggagtttatattttagtggagtagaggggtttagattataaataaataattaaatgtacgatgtaattaatgaatgttgttttgggtatgtaataattattttttttgtgatttatttggatagaagaaaagattatttttagtttattttagtaatttatttaaaggaatattaatatattacggaatgttaattgtggatttcgagatgttgtttttgagtttgggggttagaatatacgtgtttagatgtttttttgggtagatagatcggagaaacgggttggtatgtataaatatgttagtagttagggagaatagtatgttttattagttgttggtagttagggcgttgaggattgaagtttgggtattagttgggttttattaaaggagagcgaaaaatttttgaagatttgaaaaggagagttttttgtagagaagtaaatatattacgatttaaaatttgatgttttaattttgtttttatttttatagtggtagataatataagttagggaatatttatttgtatattttagaaatttgatgtattaaggtttttatttgagattgttgtttattttatagattaatttatatgtttaaaaatttaattagattataaagagtataataatacgtttgttatggttttttttgtcgatatattgtttagtatacgttaatgagagttttgattaattaatgtgaatttttttaagtaaaaggtttatttttttttttagaattaaagttggggttgggcgtagtggtttacgtttgtaattttagtattttgggaggtcgaggcgggaggattacgaggttaggagatcgagaatatttattaatacggtgatatttcgtttgtattaaaaatataaaaagttagtcgggcgtggtggcgggcgtttgtagttttagttgtttaggaggttgaggtaggagaatggcgtgaatttaggaggcggagtttgtagtgagtcgagatggcgttattgtattttagtttgggcgatagagcgagatttcgttttaaaaaaaaaagaataaaaaaattttaaaaaataaaaaaattaaaattgggtattatgaaggaaatttgagaaagaaaagtgattaattttagttgatgtaagtaattttacgtatttttttttttttgtatagtaagatattataatttatgattgttaaatttgagatagttgaagagtttagaaaaaaagattagggaagaaaatagaattgaaaaataatttagaatgatagaggttatttgtagtattaagggtaaaggcgggtaaaagaagaaaagggagatagaataaaagataaattaaaaaattgaaataaaatatacgggaatttaaatatttatattagaatataagggaatattttggaatttaaatatttttttaggtaagaatgtgtgttaatataaatgtttggtatattgttttttttttttttttttttttatttagtttatttagttttaaaagtgattttttaaaatgtatttttaaaagaatattttttgttaagtgatttaaatttgatatattttttggattattaaggaggttaaagttatatttggtgaaaaaggggtttattttttttttttttatatacgggttatcgaatatttttaaaagtattttttattatgaatgaggggaaatggaagaaaagaggtggtgataattatttgtattttttaaatggacggaatgagttttcggagggtatacgaggttattagcgtgagttcgcggtggagttggaggcgtatttatagttggttgattttagttttgttgggttttcgtcgttttttattttatgtcgttggaattcgcgggttcgtaggttataggagttcgggcgcgtcgggtttggcgttttcgaatcgatgagggaagtcgtttttttcggtagattttttcggtcggggagtttttattattttgtttgcgtttcggtacgttggtaaggagttcgggaagagacgtcgggagcggtgggtgggcgagaaataaatgtaatgtgatttatatttttttttgtcgtaattattacgatttggttattttttattttggtgatttggtgtttttttagcgattttattttacgttagttgattggcgtttatcgtagtgtgagtgtcggtcggaggaggggtttacgcgaaagagttcgcgagagtggggatattcggtttcgaaggtcggagcgggcgtttagggcgtcgatggtcgtagcgttcggtagtcgtgtttacgttttttttcgtcgcgttttatcgcgtgttatttacggcgtttgcgggaagttattcgggcggtagttgtggggttggtttgtggggaggggtcggcgggttcgcgcggaggagtagtttcgattttcgttcgtattagtagttcggcgtttttttgtcggcggttggttttttttttcggtaattgggcgtcgggtttcgcgaatttttcgggcgttttcgtcgtgcgttcggtttttttcgtgttcggggcggggcggggtaggcgttcgtggtcgggtgcgcgcggcgcgggcgggggtttttttagtgcgcgcgcgtcgtgtaaggttcgcggacgttcgttttttttttaggttttcgtattcgcgtcgttttttttttttttggtaagagtcggcggcggtggcggcggtcgttgtagagattggaattcgtttgtcgggtttggcgaaggagaagggaggaggtaggagcgaggagggaggagggttaagggcgggtaggaaggtttaggttcggcgcgttcgttcgcgcgcggcgaagatcgtacggttcgatcgaggggcgatcgggtcggggtcgttgtacgttaagggcgaaggtcgattcgggttttatttcgtttcggcggttcgtcgcgtttattcgtttcgcgtcgagggttggaggatgcgttttttggggttcgggtgagttgggagtgcgcgtgcggatcggaggggttggtcgtagcggggaggttagaggggttcgggcgaggttgtagaggtagttgggcgcgcggtggtcggagttaggggttgttcggttcggtttcggtagtttcgtaggtttcggcgcgcgttgggtcgggatcgtttagttagagatttacggtatttcgcgtcgcgtttttcgtcggttttttttttgttttttattcgcgggttgtaggtcgagtttggggatgcggagtgggcgaaagtcgtttcggggacgtttttggaatttttaaatgggaaaggcgtttattttttcgtttcggagcggcgaggttgatatttgtgatttggtttcggacgttgtggggaggaataggggagaataaaatgagtttcgggcgggggtcgagtgagaggagtagtcggttcgttttcgagttttcgcgggaaggggttttggttttcgagttttcggagttgttttatttgttgttttgcgcggttttcgtttcgtggtttggtgatttcgtattttagttttggaaaattttttgttggattgtttggatttttttttttttttttagatttttagtggaaagatttggtaaggaaaaaaaaatgagtttgcgttagggaagaaaaataatatgttgtgtgttagggtttggcgtttgagcgtggtatttttttatgtttttagatgttttaatttggttaaatttttgtaggtttttttttttaagcggttaataaattgtttagagtatatagtatgaatttggtatttgtgttacgttatttaatttttataacgattttggtttattgtattttttattgttttaggggaagaaatcgagtcgtaaagaggttaattaatttgtttaagggagttgggatttgaatttaggaatatcgtattttggtaaacgaattaggaagaaaaaaaattaaaattgtttgtaaatatttttacgtttaggaatattttttagttatttttatttgaaattatcg

SEQ ID NO: 44 - DNA, 4160 bp, Artificial Sequence
  chemically treated genomic DNA (Homo sapiens)
cgataattttaagtaagagtaattgaaaaatgtttttaaacgtaaaagtgtttgtaaatagttttggttttttttttttttaattcgtttgttagaatacgatgtttttgggtttaaattttagtttttttagataagttagttaatttttttgcgattcggtttttttttttaaaataatgaggaatataataaattagaatcgttgtaaggattaaatgacgtaatataggtgttaagtttatattatgtattttgaatagtttgttaatcgtttaaaagagaaaatttgtaggagtttgattaaattaaaatatttgagagtatgaaagagtattacgtttaaacgttagattttaatatatagtatattattttttttttttgacgtaagtttatttttttttttttgttaaatttttttattaggagtttggaaagagaaaaaagggtttaggtaatttagtagaaagttttttaaaattgaagtacggaattattaggttacggagcggaggtcgcgtaggataataggtgaagtagtttcgggagttcgggggttagggttttttttcgcggggattcgggggcgggtcggttgttttttttattcgattttcgttcgaaatttattttgtttttttttgtttttttttatagcgttcggagttaaattataaatattagtttcgtcgtttcggggcggggaggtgagcgttttttttatttaaggattttagaagcgttttcggagcgattttcgtttatttcgtatttttaaattcggtttgtaattcgcgagtgggagataaaagaggggtcggcgggggacgcggcgcggggtgtcgtgggtttttggttgggcggtttcggtttagcgcgcgtcgaggtttgcggagttgtcggggtcgggtcgggtagtttttggtttcggttatcgcgcgtttagttgtttttgtagtttcgttcgagtttttttggttttttcgttgcggttagttttttcggttcgtacgcgtatttttaatttattcggattttagggaacgtattttttagttttcggcgcggagcgggtgggcgcggcgagtcgtcggggcgaagtggggttcgaatcggttttcgtttttggcgtgtagcggtttcgattcggtcgtttttcgatcgggtcgtgcgattttcgtcgcgcgcggacggacgcgtcgagtttaagtttttttgttcgtttttggttttttttttttttcgtttttgtttttttttttttttttcgttaagttcggtaggcggattttaatttttgtagcggtcgtcgttatcgtcgtcgatttttgttaggaggggagggggcggcgcgggtgcgggggtttgggggaggggcgggcgttcgcgggttttgtacggcgcgcgcgtattgggaaggttttcgttcgcgtcgcgcgtattcgattacgggcgtttgtttcgtttcgtttcggatacgaaaagagtcgagcgtacggcggaagcgttcgaagagttcgcggagttcggcgtttagttgtcggggaggagggttagtcgtcggtaagggggcgtcgagttgttggtgcgggcgggagtcggggttgttttttcgcgcgggttcgtcggtttttttttataagttagttttatagttgtcgttcgggtagtttttcgtagacgtcgtaggtagtacgcgatggaacgcggcggaggggagcgtggatacggttgtcgggcgttgcggttatcggcgttttggacgttcgtttcggttttcggggtcggatatttttattttcgcgggttttttcgcgtggatttttttttcggtcgatatttatattgcggtgaacgttagttagttggcgtgaaataaggtcgttgggaaggtattaagttattaaggtgggggatggttaggtcgtggtagttgcgataaagaaaaatataagttatattgtatttgtttttcgtttatttatcgttttcggcgttttttttcgggttttttgttagcgtgtcgaggcgtaggtagggtgatggaggtttttcggtcgggaggatttgtcggggagagcggttttttttatcgattcgggagcgttaggttcggcgcgttcgggtttttgtgatttgcgagttcgcgaattttagcggtataagataaggagcggcgagggtttaataggattgaggttagttagttataaatacgtttttagttttatcgcgggtttacgttggtgatttcgtgtatttttcggaggtttatttcgtttatttggaaaatgtaaataattgttattatttttttttttttatttttttttatttatggtggaaaatgtttttaaaagtattcgatgattcgtatgtgaggaaagaggagataggttttttttttattaaatgtgattttaatttttttagtaatttaagaaatgtattaagtttaagttatttaataaaagatgtttttttaaaggtgtattttaaaaaattatttttaaaattgggtaaattgggtaaaaagaaagggggaaggaaaataatgtgttaggtatttgtattgatatatatttttgtttgaagaggtgtttagattttagggtatttttttatattttggtataaatgtttgaattttcgtgtattttgttttaattttttggtttattttttattttgttttttttttttttttttattcgtttttgtttttaatgttgtagatagtttttgttattttgaattattttttaattttgtttttttttttaatttttttttttgggttttttagttgttttaggtttgatagttatgggttgtagtattttgttatgtaggaagaagaggatacgtgagattatttgtattaattaaaattggttattttttttttttaagttttttttataatatttagttttagtttttttgttttttggggtttttttgtttttttttttttgagacggagtttcgttttgtcgtttaggttgaagtgtagtggcgttatttcggtttattgtaagtttcgttttttgggtttacgttatttttttgttttagttttttgagtagttgggattataggcgttcgttattacgttcggttaattttttgtatttttagtatagacggggtgttatcgtgttaataggtgttttcgattttttgatttcgtgattttttcgtttcggttttttaaagtgttgggattataagcgtgagttattgcgtttagttttagttttagttttaaaggaaaagatgggttttttgtttaaggagatttatattgattggttaaagtttttattgacgtatgttgagtaatgtgtcggtagagaaaattatggtaagcgtgttattatgttttttatagtttagttggatttttagatatatgaattggtttataaaatagataataattttaggtgggaattttagtatattaagtttttgaaatgtataaatgagtattttttggtttgtgttatttgttattgtagaaatgagagtaaaattgaagtattaaattttaagtcgtgatatgtttgtttttttgtaaaagatttttttttttaaatttttaggaatttttcgtttttttttgataaggtttagttagtatttaggttttaatttttagcgttttggttattagtagttagtggggtatgttgttttttttggttattggtatgtttatgtatgttagttcgttttttcggtttgtttgtttagggagatatttggatacgtgtgttttggtttttaaatttaaaagtaatatttcgggatttatagttaatatttcgtaatgtgttggtatttttttaagtgggttattagaataggttggaaatggtttttttttttgtttaggtaggttataagagaggtagttgttatatgtttaaagtagtatttattaattatatcgtgtatttagttatttgtttgtggtttgagtttttttgttttattagaatataaattttatgagtaaaagattttgttagtttttttttttttagagataggtttttattttgttatttaggttggagtgtagcggtatagttatagtttattgtaatttggaatttttgggtttacgtgattttttttttttagtcgt

SEQ ID NO: 45 - DNA, 7824 bp, Artificial Sequence
  chemically treated genomic DNA (Homo sapiens)
tcgtggttatagggttaattaaaatatatgtatttatatatattttgggtatttattttatttattgaattttattaatttatatatgtattataaaaagaatttgttttttaaatttatagagtttagttttattttggatataatgtgtttttaaaaatattgagagaatgaatggaaatattttattttatatgagtaaataaatgtattttatagatttaattttttaaatatttataaatttatgtttttttttataaaaatggatttaaattattgtttttattatttttaagattgagaaaggtatgttttaaaagagagtaatatttagttgataataagattgttaaacgtgaaattaaagataaattaaggagttaagttttaaagaattagtataagttgtttttttagtaaagaaattaaagaattaatttgaagtagaaagaaattttttgaatttgtaatgtttttttagttttaaatttttattttttggtttttggttttacgattgtttatatattttaaatattataaatgttaagtgtaaatataattttatataaagttttattgtatagaaaatagagtatggttaatttaagggggttatttattttatttgatttattatttattttgggggttggttttaatatgtgtagtgtatgtttgaatgttttgtgttaattttattgataatttttgttgggattagggaatattgtgaataagtaagtagaaaatgagggttgggtgtggtggtttatatttgtaattttagtattttgggatgtcgaggtgagtggattatttgaggttaggagttcgagattagtttaattaatatggtgaaattttatttttattaaaaatataaaattagttaggtatggtggtgtatatttgtaattttagttatttaggaggttaaggtaggagaattgtttgaatttaggaggtagaagttgtagtgagttgagattatgttattttattttagtttgggtaataagagtgaattattgttttaaaaaaaaaaaaaaaaaaaaaaaaaaatgagatttgttattatttgtaagatttgtggttagtttggtattatattttttatatgttagaaaatatgttttaataaatatttgtgaatgaatagttattttatttgttatgttttttattttaatagagaattattagattaaattttttatttttttgatttataagatttcgggtatatttaaaaaaaaataatatatttagaagttttaagttcgttgttgaaataagtattggaaaaaataagtgtgttattaagtattatttatttataaatgttaatatttttatttttaagtaattttgaatgtagttttttaattagaaatttaatataaatgaaaaatttttttttatagtttattttgaatcgttgtatttatagaggtagttgtttagttttaattaatggtacgggaaaaataataggaaaaaaatcgaaattgtatgttttttaatgtgatagttttaaattgatggagtaagttttttagagaaagtatttttaaagtgtattattggttgaggtaagaatgttgttattgttttttttttttttttttttttgtttgtagttaaattaagatttgagaaataaggttttattaaatagttgttttagaatttttagttttattaaagtttagatataaattatatttaaaagtttttataatgaaaagttttttataaatatcgtgggggttgatttaattattagaataaagaagattatattagtgaagtaaagaattttttaaattttttataattaggagaaattagtaattggtaaatatatatatatagatatatttattataattaattattattattgttattattaataataaattgtaaattacgattacgattgtgaaaaaagtaaaattaacgttaaagtttttattggtttaaggtgtattgttgatagtatttagttagtaaagttttataattatgatatttatttagattgttatgttaaagaaaaggggtttttattttattttttgggagtttttttttttttcgttatcggttaatttttgtttagtatgttttttttattttgttttatttttttttatttcgaggtgttcgaagagtatgattttagagggagttatttagtaagtgttttttagttttagttttttttattttgtagtttttatgatttaataagaagttgtgtatataatttttaatttatagtaaattgagtttttgtagaaggattttaattttttttttagaagttttaggataatttttgttgtttttttgtagttttttttaaagaatttatagtttggtttatacgggagtatattttgttttgatttttttgtattggtttttttaaagttagagaatagaattttttatagcgttaggtatttatttaatgtaaaaaatattgtagaattgattttttttttattttttgtttttttttaattgttttttcgggattatatttattatgttaatgagttgtattttagatatttgtgaaaagatcgattaatttagttggttgtattttaaaagttttagagtttgttaatcgagattagtttaaggtttttgaaaatatatttgttttaaagattaaagattaaaaattgttataatttgttttggtttaatagtggtttagagtgtaggttttggaataataatgttaatttcgggagtttggagtcgttatcgatagaagatttagtgtaagttatttaatttttttattgtttgttattttttatatgtgttaagtgtttggaagagtatttgttttataataagtttttaattatttggagtaaatgtaagaaaatttaaaagttagattttttgttagtttttacggttatagaagggttttattatgaattaagttgataggagttaaaggaatttttttaagttatttgtatatgaaaaatgggatttttagtggtttttattttttttattttaaattttaaaatatagttgaaatcgtttatgttaataaaattttacgaaatattttatatgttgaagagtgattaaaagaatttgtttttaagaaaaataaatttatttttttttttattttttttttttatttattttttttttttaattttaaatttaaaaaattataaagattgacgtattaattgtttagaaaaagtagaattttttatatttcggggtgattaaattttatttttggtttcggaggattggtagagagattcgatttaattattaagtcggggttgtaaaaaagttagtttattagggtattttatttaagtatatttgggaagtaggggtttttaatttatattatagatcgttagaagtaaggataagataaattagattatttgggggttgaaaaaaacgacggtcgaatatttaatttgcgaaatttggtagtggatttgaataaatttatagtcggggaagttagttaaattggtttgggaaagggaatagtagaaatttcgtagtggtagttgacggttataagacgttattttatatgagtaaaaatgtttgttataaggtgttcggttgtaggcgatcgaaggcgtagtgatggagaattgacgcgggtgatttgttttttttaatattatatatttttttcgatggttgatgtagtgtttttttgggagtattttttgttagttcggttagacggttttttaaggtgttaggagggttcgaatttgagtgcggttttttcgtattttcgcgttcggggttaacgatggtttgggagtgtgggtattgttttcgaggttaggggtaggaggattggtggtttagaagtagaggggtttgcgggagagaagagaatagaaaatttcgtagacgcgcggtggttttttttttcggcgtttgttcgtcgttttcggtcggaggttagtaaggttagtaggatttatttttcgtttgcgttgtggtcgcggagttttaagcgagtcgtgttagtttcgcggttggttagcgagggggcgagcggcggacgtagcgcggttcgagtttttcgagttagttattttgggttgcgttttttacgtttatttttttttagacggggcgagtgggcgtcgtttggtattgaagttgtagcgcgtttatttgtattggtcgaatttggcgtatattgtttattcggtggggtcgttttcgtaggtttttatgatggtttgtattttttttatattgattttatcgtcggtaaagagttggtgtaggatgcggattagattagttagggttcgtggttttagtatttcggtttgttttatttcgtggggagttggttgcgcgcgcgttttattgttgggttgcggtggaggagttgagcgagttaaggagttgggggcgagggagtttaatagttcgttagatcgttaagtagatatatacgtataaatttagtattagagtgtcgaaacgtaaggatgtcgtcgtagagatagtaagagatttatttttaggtttttggtagcgtagtggattcgggatcgttggagacgcggtgtatatataaattaggtttagatttgtggggtttattttttcgggttttttttaagcgtttggagttattaggaatgtattaacggttttcggagggaggacgaggcggagagttatttaagaaaggtggcggaggcggggagattttgcgggtacggtttacgcgtatattttcggttttttcgggtttcgcgtttttttaagagtttcgttgttttcggcgttttagggatcgcgtgggtttcgcgtaattttttttttattttaacggcgcgttttagtcgttcggtttaacgttttttttcgttttattttcgtcgttgtggttcgcgacgttgggacgtagataaaaagggtcggaggagatggttgcggggattgacgttgagtaaaggaggaaaagaaaagggaaggagagggatattttttttaaatagagaattgtgaggagtttgcgaaaattgaggatggattttatttttaggttagagagtgtttgttttgtcgattgaaattatttacgatatgttttaggttaggtgaaaataagtttaagattttatatatatatatatttaagtatatatatatatatattttttaaaatgcgtattgaaatatattttgataaaggagattcgggtttttagtaagataattagtgaaatgatggaaaattaagaattttttgattttaaaattaaatatttttttttaaaaaatatttagtgtaaataatttgatattttatttgatggtgtaaaagggggttttttttgaggggatagggcgggttttgacgtaataatttaagaggttataattatatttgaattttttaattttaggtatgtgtttgaaggagtttgttagtatatatatataaggaaatacgtttttacgttatgtatagtatttagtacgttgggaataatataaattaagtatagtaggatttaaatgagaaagatgtgaaaggtggaagaaatgtaagtgtagatttttttttttttattatggatggacgtagggaataatttggatttaaggttattaaagttttagatttttgaagatttgtttttttttagattatgattattttttttcgtgtatatatatgtatataatgaaatttatttgtgttaggtagttttaaatatttttggtaaaattcgttatattatattttaatagtgttgttaaaagcggaattatttattgtttaaaaatggttataagtagaaagtattttagaagttagttttggtgatgtgtgttgttgcggggtagtgaattaataaagtattttgtgatagagtaatttgtaaattttttatggtttttttaaattattttttatttttggtaatgttttttattgagttttttaattattttattttagttagtttaatttataaatgtttggaatgaataataaaaatgaaatgtaagtataatttattttttttgtattttagttgataaaatttttaaatttttttgataatttattttttttttttgatttttttttttttttttatatttttatgaaagtaatatatttacgtagttaaaaaaaattaatagtattggaaggttaatgaaaagtagtaggtttttttaattatttttgattatttgttttgtgtttaaagagttagttttttaatttttttaattattttttgtggtagttattttttttttttaaaaataggtttatatttttttttgttttagtaattttagatattatttagttattttatattatgatagttttattcgtttattatttatttattaatttatttaataaatgttttttcgggtgaatagaaatttttattttatttgagtaaatatttaggagtgagattgttgggttatttagttagtgtatgtttaaatttgtaagaaattgatatattaatttgtaaagggtttgtgttattttatatttttaatagtgatgtatgagttttagttgtttcgtattttcgttaggtattgttagttttattaattttggttaaatagaggtgtgttgatattgtattgtgttttttattttttatatttttaatttttatgggtaggtttttgtttttagagtttttaagatggtggttatcgtttttaggatggtagtaagttttttgttttttgaattggggtttttggttttatggattttaaggaatggaattttggattatgcggtgagtgttatagttttattagaagtcgtgggttatagaagagaatcgtggaatttagttattagtgtttagtttaaataggacgaattcgggtatttagttatgtaggaataatggtaagtttttagtcggatcgggagtggtaatgggtgtttcgttggattagtaaagtagcggatattttgtcggatttggaggggtggaagtcggtggcgggtttgtgatagtggtaaatagtagtggtgaaaagcgagcgaaagtttagttcgagttataataaatatagattagaagagtgtgtagttgttagatttaatagagtgaaaatatagtttttatataatgcgacggtacgtaaagagggttgttattttttgttttaatgtttgggtttatattcggattattgttttttttttatgtttttaggcgatatattatttgattatttttttattttttgttttagtttaatttgtattttagtgagttttttttattgtttgattggttgggtgtgagttgagttataagtttcgtgtttaaaagtagttgtagttattttttttagttagggtttaggaatttttagtcggtttaggaaatttagtttgttttgttttttataatgattaatgatgttgagtatatttttatgtgattagttatttgtaaataatttttggtgaaatatttaagtattttgtttttttaaaaatttaattatttgtttttattgttgagttttaagagtttattatatattttagaaataagttagatgtgtgatttgtatatatttttttttagtttgtgattggttttttgtttgtttttttggataaaggttttgttgtgttattgaggttggagtgtagtggagttattggtttattgtagtttttaatatttgagtttaggtaagtttattgtttacgtttattgagtggtagggattataggcgtg

SEQ ID NO: 46 - DNA, 7824 bp, Artificial Sequence
  chemically treated genomic DNA (Homo sapiens)
tacgtttgtagtttttgttatttagtaggcgtaggtagtaggtttgtttgagtttaggtgttgaaagttgtagtgagttaatggttttattgtattttagttttagtgatatagtaagatttttgtttaaaaaaataaataaaagattagttatagattgggaggaaatatatataaattatatatttgatttgtttttagaatatataataaatttttaaaatttaataataagaatagataattaagtttttaaaaggataaaatatttggatattttattaaaaattatttataaataattaattatataaaaatatgtttaatattattagttattatgagagataggataagttggattttttaggtcgattaagaatttttaagttttagttgggaaaggtgattgtaattatttttaaatacggggtttgtaatttagtttatatttaattaattaggtagtaaagagggtttattaaaatataaattaggttaaagtaggaggtaaagaaatagttaaataatatatcgtttgagagtatgggggagggataatgattcggatataaatttaggtattaaagtagggagtggtaattttttttgcgtgtcgtcgtattgtatgggagttgtgtttttattttattaaatttagtaattgtatatttttttggtttgtgtttgttatggttcgagttgagttttcgttcgttttttattattgttgtttgttattgttatagattcgttatcgatttttatttttttagattcggtagggtgttcgttgttttgttgatttagcgaggtatttattgttattttcgattcggttaaaggtttgttattgtttttgtatggttaagtgttcgggttcgttttatttgagttgaatattagtagttgggttttacggtttttttttgtgatttacggtttttaatagagttataatatttatcgtatggtttaaggttttattttttggaatttatgaggttaagaattttagtttagagaataaaaggtttgttgttattttgggagcggtggttattattttgggagttttaagaataaagatttgtttataagaattagagatatagaaaatgaagaatataatgtaatattagtatatttttatttggttaaaattggtaaaattgataatatttggcgaggatgcggggtaattagaatttatatattattgttgagaatgtgaaatggtatagattttttgtaaattagtatgttaattttttgtaaatttaaatatgtattgattaaatggtttagtaattttatttttaggtatttatttaggtgaaatgaaaatttttatttattcgaaaaaatatttgttgaataaattaatgaatgaataataaacgaatggagttattataatgtaaaatgattagataatatttaaaattgttgaaataaaaaaaaatataagtttatttttggaaaaaggaagtaattattataaggaatagttagaagagttaagagattgattttttaagtataggatagatggttaggaatggttaaaagggtttgttgttttttattgattttttagtattattgattttttttaattacgtgaatatattatttttataaaaatgtaaaaagaaaaagaggagttagagaaagaaaatgaattgttagaaaaatttagaagttttattaattgaaatgtagaaaagataaattgtgtttgtattttatttttgttgtttattttaaatatttatggattagattagttgaaatgaagtaattaagagatttaatagaaaatattgttaagaataaaaaataatttgaggaaattatgaaaagtttataggttattttgttataaaatattttgttaatttattatttcgtagtaatatatattattaaggttggtttttggaatgttttttatttgtagttatttttgaataataggtgatttcgtttttaataatattgttagaatataatgtagcgagttttattagagatgtttaagattatttggtataagtaaattttattgtatatatgtatatatacgagggagggtgattatagtttagaaaaaaataggtttttagaagtttagaattttaataattttaaatttaaattattttttgcgtttatttataatgagaaggaagaaatttatatttgtattttttttattttttatattttttttatttaaattttattgtatttgatttgtgttgtttttaacgtattaggtgttatgtatgacgtagaaacgtgtttttttatatgtatgtattagtaggtttttttaagtatatgtttaaggttgaaagatttaaatataattatagttttttaaattattgcgttagagttcgttttatttttttagaaaaagtttttttttatattattaaatgaaatattaggttatttgtattggatattttttaaaagaaaatatttgattttaaaattaaagagtttttggttttttattattttattaattgttttattagagattcgagttttttttgttaaaatatattttagtacgtattttaaaaaatatgtgtgtgtgtatatttaaatatatatatatataaagttttggatttatttttatttagtttggggtatatcgtggatagttttaatcgataaaataggtattttttggtttaggagtggaatttatttttaattttcgtaggttttttataattttttatttggaagaagtgtttttttttttttttttttttttttttttttatttagcgttagttttcgtagttatttttttcgattttttttgtttacgttttagcgtcgcgaattatagcggcggaggtggagcggggagaggcgttaggtcgggcggttaaaacgcgtcgttaaagtgggggagagattgcgcggagtttacgcgatttttgggacgtcggagataacggggtttttgggaaggcgcggagttcggggaagtcggggatgtgcgcgtgagtcgtgttcgtagggttttttcgttttcgttattttttttgggtggtttttcgtttcgtttttttttcgagggtcgttggtatatttttagtgattttaagcgtttaaaaggggttcgggaggatgaattttatagatttgaatttgatttgtgtgtgtatcgcgtttttagcgatttcggatttattgcgttgttaggggtttgggggtgggttttttgttgtttttgcgacgatatttttacgtttcggtattttaatgttgggtttgtgcgtgtgtgtttgtttagcggtttagcgggttgttaggttttttcgtttttagttttttggttcgtttagtttttttatcgtagtttagtagtgagacgcgcgcgtagttagttttttacgagatggaatagatcgaagtgttgaagttacggattttggttgatttgattcgtattttgtattagttttttgtcggcgatgaggttaatgtagaggaggtgtaggttattatggaagtttacgagagcgattttatcgagtgggtaatgtacgttaagttcgattagtataggtgagcgcgttgtagttttaatgttaggcggcgtttattcgtttcgtttgaggaggaatggacgtgggggacgtagtttaaagtgattggttcgggaagttcgggtcgcgttgcgttcgtcgttcgttttttcgttggttagtcgcggggttggtacgattcgtttggggtttcgcggttatagcgtaggcggaaggtggattttattggttttgttgattttcggtcgggaacggcggataggcgtcgggaagggaggttatcgcgcgtttgcgagattttttgtttttttttttttcgtaaatttttttgtttttaaattattagtttttttgtttttggtttcgggagtaatgtttatatttttaagttatcgttaatttcgggcgcggagatgcggagagatcgtatttaggttcgggtttttttgatattttaaggaatcgtttggtcggattagtagagggtgtttttaggggagtattatattagttatcgggagaagtgtgtgatgttgaagaagataagttattcgcgttagttttttattattgcgttttcggtcgtttgtaatcgggtattttatagtaagtatttttatttatgtaaaatagcgttttgtggtcgttagttgttattacggaatttttgttgtttttttttttaaattaatttaattaattttttcgattgtgggtttatttaaatttattgttaagtttcgtagattaaatattcgatcgtcgttttttttagtttttaaatgatttgatttattttatttttgtttttgacgatttgtaatgtaaattaaagatttttattttttagatgtatttgagtgaggtgttttggtaagttggtttttttgtagtttcggtttggtgattaagtcgaatttttttattaatttttcggggttagaggtaaaatttaattatttcgaagtgtgagaggttttattttttttgagtagttagtgcgttagtttttgtggttttttgggtttagggttaggagaaaggggtaagtgaaagaaaagaataaggaaagaagtaagtttgttttttttgggagtaggtttttttagttattttttaatatgtgggatgtttcgtaaagttttgttggtatgggcggttttaattgtattttaggatttgaaatagaaaaagtgaagattattaaggattttattttttatatataagtgatttgaggaaatttttttggtttttattagtttagtttatggtagagtttttttgtagtcgtgaaagttagtagagagtttagtttttaaatttttttgtatttgttttaggtaattgaagatttgttatgggataggtatttttttagatatttgatatatatgaggaatggtaggtaatgaagaagttgaatgatttgtattaggttttttatcgatagcggttttaggttttcggggttagtattgttgttttagagtttatattttaaattattgttaaattaggataggttgtaatagtttttaatttttaatttttagaataagtgtatttttaaggattttgaattagtttcgattgataaattttaaagtttttgaagtgtaattagttgggttgatcggtttttttatagatatttgaggtatagtttattaatataatggatgtagtttcgagggggtagttgggggaagataggagatgggagagaagttaattttatagtattttttgtattaaataggtgtttagcgttgtgaaggattttgttttttgattttgggagggttagtgtagaagaattaagatagaatatgttttcgtgtgggttaggttgtgaattttttgaaagaagttgtagagaagtaataaagattattttaagatttttggaggaagaattaggatttttttgtaggaatttagtttattgtgaattgaaggttgtgtatatagttttttgttaggttataaaggttataaagtagggaaaattgaggttaaaaagtatttattaagtaattttttttaggattatgtttttcggatatttcggggtggggaggaatgggataggatggaaggggtatgttggataagagttaatcgatgacgaagggaaaaaaaatttttaaaaaatggagtaaagattttttttttttaatatgatagtttaaatgaatgttataattatgaaattttgttaattagatgttgttaatagtatattttggattaatagaaattttgacgttgattttgttttttttatagtcgtggtcgtggtttgtagtttgttgttggtggtggtagtggtggtggttggttgtggtgagtgtgtttgtgtgtatgtgtttgttagttattggttttttttaattgtaagaggtttagagggttttttattttattaatgtagttttttttgttttggtagttagattagtttttacggtatttgtggaagattttttattataagggtttttgaatgtggtttgtgtttaggttttagtaaaattaagaattttagaatagttatttaatgaaattttgttttttaagttttgatttagttataggtagaaaaaagaaaaaaaaaaaaataatagtaatatttttgttttaattagtaatgtattttggaaatattttttttgagaaatttattttattagtttgaggttgttatattgagaaatatgtaatttcggttttttttttgttatttttttcgtgttattaattaaaattgagtagttatttttgtaaatgtagcggtttaaaatgaattgtgaaaaaggattttttatttgtgttggatttttaattagaaaattgtatttaaagttgtttagaggtggaaatgttaatatttgtgaataaatggtatttggtgatatatttattttttttagtgtttgttttagtaacgaatttaaaatttttgaatatattgtttttttttaggtatattcgaaattttgtggattaaggaaatggaaaatttaatttgatgattttttgttggggtgaaggatatggtaggtaaaataattatttatttatagatatttattagagtatgttttttagtatatgaaaaatatagtattaggttagttataggttttataagtagtaataaattttatttttttttttttttttttttttttttgagatagtggtttatttttgttgtttaggttggagtgaaatggtatgattttagtttattgtaatttttgttttttgggtttaagtaatttttttgttttagttttttgagtagttgggattataggtatgtattattatgtttggttaattttgtatttttagtagagatggggttttattatgttggttaggttggtttcgaatttttgattttaggtgatttatttatttcggtattttaaagtgttgggattataggtatgagttattatatttagtttttattttttatttatttgtttataatgttttttaattttaataaaaattattaatggaattagtatagggtatttaggtatatattatatatattaaaattagtttttaaaatgaatagtaaattaaatgaggtaagtaatttttttaagttaattatattttgttttttgtgtagtaaaattttatgtgaaattgtgtttatatttgatatttgtggtgtttgaggtgtgtaaataatcgtgggattaaagattaaaggatggagatttgaagttagaaaagtattgtaaatttagaaaatttttttttattttaagttaattttttagtttttttattgaaaaggtaatttatattgattttttgaaatttagttttttaatttatttttagttttacgtttgatagttttattattaattaagtattatttttttttgaaatatattttttttagttttgagaatggtaaaagtaataatttagatttatttttatgaaagaaaatatgaatttataagtgtttggaaagttaggtttgtagagtgtatttatttatttatatggaatgaagtgtttttatttatttttttaatatttttgaaagtatattatgtttagagtgggattagattttgtggatttaggaaataaattttttttatggtatatatataaattaataaaatttaatagatgaaatgaatatttaaaatgtatatagatatatatattttaattaattttgtaattacga

SEQ ID NO: 47 - DNA, 2665 bp, Artificial Sequence
  chemically treated genomic DNA (Homo sapiens)
tttcgaaaatgtttagatatatttaagaatttttattgagtaatataatgttttaattgaggtatatacgttgttttaggagtttgtgaaattttaaagataaaagtttgattatgtttgttttgattttaatgaattatttatataattttaatatatagtgtttaatacgtatgaaagttgtgtaatattttatattttaataatggagaattattaagtaattttggttattttgatattagtattttttgaaattttttaggttgatgtggtaaaggagaaatagtaattttgagttttgaaaagttaggtcgtattttggttttgaaaaattatttgttgtgaatttgggttagtttttgattttttaaatggtataatagttcgttgttataagaggttatattaggaaaattttttaaggatttaagattttgtttatttattgagtttttttgggtgatttgtttaggaggaagtatttgtttttttttgagttgttttattaaagtatttgagtgagaaggtagaatataatgagaatgattatgttggtaaggaagatatatatatgagatgggttattttttatatttacgttagttaaaatcgttttttacgaataaatttagtatttggtattttattcgacggttttaaaaatagagttttaaatttagaaggtaaggtgttatttttagttttttttttcggaggaaaatagtacgtatcgcgttaggttaaggtttacggggatttgatttagtatttgggtaattggtcgttaatggaattgaagatagttgggtttaataagtgtttaggtgatttaggtaagcgaggaaattagatcgaggtttttttgcgtgggataggttaaattttgattaaattatagttgagtcgggacgtttttttgtttaaagtttaaagttcggacgtggttggtagggcgtatcggcgcgtgtttcgtaggttatttttttgattggaatgacggcggcggttggtttttcggggttgtcggggtttttcggggtacgtcgtcgttaggatttttgtagggcgtagatagtaggttttagcgaggttgcggaaggaaagttttgggtgtcggggttgggtttggcgtcggtttttgggtcgggggggtgggggttgcgtcgagacgtttttaggagaagtttcgtcgtcgtcgttatcgcggtcgttcgaggcgggtgtttttgggatatagttttggtttttggggttgtgcggtttatacgatagcgcggagtatgaggtcgaattttattttttagttttaagtttttttattattagggttgggtggtttcgttaggtagagcgtcggtttttttaagagtaaacgattcggatacgtttgcgaagtttgcgcgaagaaggggaagtttgcggttgttcgcgttttttcgttttttcgcggttgttcggtcgaaattaaatcgaggggtggggtggcgaggatagggtacgtcgtaggtttgtgcgggtcgggttcggatttgcgttgtttcgggatgtaaagtataataagagggtcgggatgggtagcgtaggtttgtgaggtttgcgggtgtttttgttttttagtttttttcgtagtcggtttcgtagtggtttatttcggttgtcgggtgcggattcgggtttcggatcgaaggttgtgtgtttttcgtcgtttattgtggtttcgataggtcggggttattgtggcgattacgagagtagttttggcgttatggaggagttcggggttattttttaatcgtatttggggttgtttttggaggagttacgtagggtgagtttaggcgcgatgagtgttacgtggtttaggggtcgcgggagtcgtcgggggaaggaagtagtagatcggttttggggtttaagtcgtcgtggttagaggtttcgaagttagttttcgtttgttgttcggttttcgttcgtgttcgaggtagtagttaggttcgtagggcgtttgagtggtttttgtgtgatggaggaggatttggggttttgggaaggtgaagaaagtatttgtttagttggattttgtaaagatgtaaatgtttttcgatttttaaaattaattagttttttcgttatgttgtttattttgagtagagatacgtggttttttcgattgtgagaaatttgaggattgtttttttaaattagttatatttattgatgtaatttttcgttgaattttgaaagaatatttgaggttgggcggggagttgaaattttgattttgtattttttttttttttggtaaagaatgaatgtttttttgagatgttttattatgagtgagattgtttttcgtttttgttttgttaatgtatagtttagagatagtaaatttttagtgtttaaattttgttttttattttttaggtttagtttataattaagttgtagagatttttttttttaagtgtttttaggtatttttgttgatatgtgtaggggtatttatgtcgtcgtgtttttaaaaattggattaaatttttaaaaagattatttaattattgaggtagttacgattatgtttttttgttaggtgaattaaaggtagtgttgttatggtgtttatgagtttatagtttgtttaatgtatacgtatatatat

SEQ ID NO: 48 - DNA, 2665 bp, Artificial Sequence
  chemically treated genomic DNA (Homo sapiens)
atatatatgcgtatgtattagataaattatgaatttataaatattatggtaatattatttttaatttatttaataagaaaatataatcgtaattgttttaataattaagtggtttttttaaagatttaatttagtttttaaaaatacggcgatataaatgtttttatatatgttaataaagatatttagaaatatttaaggagaaaaatttttataatttgattataaattagatttgaaaaataaaaaataaaatttgaatattgggagtttattatttttagattgtatattaataagatagaagcgaagaataattttatttatggtagagtattttaaaagggtatttattttttattaaaaaaaaaaaaaatgtagaattaaaattttaatttttcgtttaattttaggtgtttttttaaggtttaacgagaagttatattagtaaatgtaattaatttaaaggaatagtttttaagttttttatagtcgaaggaattacgtgtttttgtttaaaataaataatatagcggaaaggttaattagttttaggaatcgggaaatatttatatttttgtaaagtttagttaagtaagtgttttttttatttttttagagttttaggtttttttttattatataaaaattatttaagcgttttacgagtttaattattgtttcgaatacgggcgggagtcgggtagtagacgaggattggtttcgggatttttgattacggcggtttagattttaaagtcggtttattgtttttttttttcggcggttttcgcgatttttgggttacgtaatatttatcgcgtttgggtttattttgcgtagtttttttaggagtagttttaaatacggttgaggggtaatttcgggtttttttatagcgttaaagttgttttcgtggtcgttatagtaatttcggtttgtcggggttataataaacggcggagaatatatagttttcggttcggaattcgaattcgtattcggtaatcggagtggattattgcggagtcggttgcggggggagttgggggataggggtattcgtaggttttataggtttacgttgtttatttcgatttttttgttatattttatatttcgaggtagcgtaggttcgagttcgattcgtataagtttgcgacgtattttgttttcgttattttatttttcggtttggtttcggtcgggtagtcgcgagaaggcggggaggcgcggatagtcgtaaattttttttttttcgcgtaagtttcgtagacgtgttcgggtcgtttgtttttaaaggggtcggcgttttatttggcgaagttatttagttttggtagtggagaggtttgggattagaggatgagattcggttttatatttcgcgttgtcgtgtgagtcgtataattttaaagattagggttatgttttaagggtattcgtttcgggcggtcgcggtggcggcggcggcgagattttttttagaggcgtttcggcgtaatttttattttttcgatttaggggtcgacgttaggtttagtttcgatatttaaggtttttttttcgtagtttcgttggagtttgttgtttgcgttttgtagaagttttgacggcggcgtatttcgggagatttcggtagtttcgagaagttagtcgtcgtcgttattttagttagaaaaatggtttgcggggtacgcgtcggtgcgttttgttaattacgttcggattttggattttagataggaaggcgtttcggtttagttgtggtttggttagagtttaatttgttttacgtaagagaatttcgatttggttttttcgtttatttgagttatttgggtatttgttaggtttagttgtttttagttttattagcggttagttatttaaatgttaaattaaattttcgtggattttggtttggcgcggtgcgtgttgttttttttcgagaagaggagttaaaagtagtattttgttttttaaatttaggattttatttttaggatcgtcgaataaagtgttaagtgttggatttgttcgtaggagacggttttagttgacgtaggtgtaaaggataatttattttatatatatgttttttttgttagtatgattatttttattatattttgtttttttatttaagtattttggtgaagtaatttaaaaaggagtagatatttttttttaaataaattatttaaaagaatttaatagatgaataaaattttaaatttttaggaaatttttttgatgtaattttttgtagtaacgaattgttatgttatttaaaaaattaaaaattggtttaagtttatagtaagtgattttttaggattaaaatgcggtttagttttttagaatttaagattgttattttttttttgttatattagtttgaggagttttaggaaatgttaatattagagtagttaaaattgtttagtaattttttattgttaaggtataaggtattatataatttttatacgtgttagatattgtgtattaaaattatgtgaatagtttattaaagttaaaataagtataattaaatttttatttttagaattttatagatttttagaataacgtgtatgttttaattagaatattgtattatttaataaaaatttttaaatgtgtttgaatattttcggaa

SEQ ID NO: 49 - DNA, 8788 bp, Artificial Sequence
  chemically treated genomic DNA (Homo sapiens)
gtcggggtttgtagtttgggtaattgaggagttaaacgtttttgagtgttgtgtttttaggtttttttggattttttttgggtttttttaagttgaggtagggggtgggttgggggtggagtaggagaataggaggtcggtagtgaggtataagttttttttcggtaatagtgagtttgaagatatgtagttaagggtaagtgttgtagtcgttttcgttgggatgggtggggttgtgattttttagcgtttagaggagagaagtttttttggttttttaattaagtagtggtgatgaggttagaaattagagtttatttagagtttaatatataggtttttttttttttttttttttattttttgggattatttattttttttaaaagtaatttttgtttttatttttaggatttaaggttcgtttgttaagtagcgaattttaataggtttttttaaagtgatagagtttttaggtgtgtttattaaaagaatatggtttcgtgtgtattttatgtgtttttttttttagttttttgttagtaagattaatttttttaatcgttttggatgtaaattcgtgtatcggtaagagttttgattggttttgatggtatttcggatttgggatcgggtgagtttggttttaggagtttttagaaagttttttagtttaatgtagagataggagtttagttggtttttttaagtaggtttgggaagggggtttattttgagtttaagttcgggaaatttaagggtttagttgtttgacggaagttagttaatgggggaggggtaggatttttggttaagttttttttgtagtgtagtttgaggattaagtgtggggatagggggtatataggtattgtgaggtgaggggaaaataaaataaaataaaatattttggcgatgtgtgtaaggagtagatttgtttggagtttaggtttttgttttggttatttggttgttaatggggtaattttgagggttatgttattttttttaggttaggaggagtttgggatgaattttacgtttttgtgttttttttaggttagttgtatttataatttaaagatcgaggttttttattttaattttttttttagtttttcggggagggggtagtattattttttagagcggcgtattgtgatattttcgcgtttattttattaattagttaataattgtttaaattagagattttataggaatagaagaatatttagtaataaaaattagaaatatgttttatgatttgcgggggggggggggggttagtgtgtagatatagttttagggattttttattaacgacgaatatttttaattgtttttagtttgtgtttttaatatttaggtagttcgttacgattttaggttgtttagtttttttagttcgatttagttgcgttggttttgtttatattagcgtatagtttaagttagttaggacgtcggggttacgtttgtattaatttagttaagggttcgaggcgcgttgggtttgtatagttcgcggttgtaagagtatttagagtgttttttaattttttgtaggaaattttatagttaaggaagtttagcggtttgagttatagggttttgttttgtgtgtttagaggtaatagtttattttggtttgtatcggtgttttgtgatagcgtagcgagtttttttttagcgaaagaaaagaaaaaagtttttttttagtgaaacgggatattacggtttttagtggtttagggttttggagattgaattttgttgtagtttttattttggggtaaagcgtttggttagttggtgataaaagagtttgtttgtaggtgtgtttggggagttggggagggggcgtgtgaggttcggagggtttttgggttttttttaggtgaattcgagaagagataggaagatagcggttggacgcgcgtttaggttcgcgtcgttgcggatcgcggagttgtgtagaagcgcggtttggcgggtggtataagttcgatagttgcgtcgcgtagttcgttcgcgtttggttaagagtttcgcgagggtgtggggagaggatcggtttcgtagggagcggaggttgcgcggttgtatcggattttatagttttaagtcgcggtatgaggcgaattttgtaaagcgcgttttcgttatgtatcgttcgatttttagtattgtgcgtagtaggatttcggagtttattcgtttgtggaaatcgagttcgtagcgggaaggtagtgggtggagggtgggtaggtaggggtttggggttcgcggttttttattttcgcgttttttcgcgttagtttcgaacgtttttttggggcgtttttgtttagttgtttcggttgatttcgttttgtagttagtttgaggttaggcggtcgttttttgtaggttataaattttcggcgtaaaagtagggttttgaacgcgatatcgtattagagcgtttagttaagcgagttgtttttatttttattgtgtcgggcggcgtaaattgcgggcgtaggtagaggagtcgcggttttgcgtcgggcgggagtcgaagtttagagtttcgttagggttttttcgtcgagcgtatttatcgtcgttgaggtagagcgcggttagtacgaggattagtacgattacgattttggcgtttatggcgcgggcgggcgggcgggcgggcggacgagcgcgggtcgggggtcggacgtcgagcgggtaatgcggttgacggagagtgaaagtgcggcggtgggaggcgcgcgtcgggcgttttagaggggagagttaggcggggcggggcggggcgcgcggtgaggggcgggttcggagtcgagtgttggtcgtggtcggggtttttgacgcgcgattttttcggcggtattttttatttatttttttcgtttttttttcgttttttttgtgttttcgaggcgtagtgcgtttcggtttttgatttttttaggtttcgttgggtttcgtatcgttggttcggtttgtagtgaggttcgtagtttgagcgacgtcggttggagggtcgtttattgtttttgtgatagggttttattggagagattgaggattttaggcgtaaagtggggcgcgcgtggaaagttgcgggacggggtttttcgatggcgggaattgaatgagaattaatgaaaagtaaataagttagtttcgggcggagggtttgttggcggtggcggtttaaggtagtcgagggggttttgttttttgtgcgtgggggtttaagttcgttatttgttcggtttgcggcgtagtcgtcggtagagttcgatttgcgggaatgagattcgtttttgtagttagcgtggttcggattttaagtttacggcgttattagtcgagttttagttttttcgtttgtataaataaagtagaaggcgtcggcggtttttagtaaaagcgaatgtagtttttgtattttcgattttttaatggtgaaatgagttaattataggtttatttcgcggagtgggacgggagatttaatgagattcgttttacgtcgcgaaattttttgtatcgtgtttgataagtagatagtatttaataaatggtagttgtaagtaagttttttaaatttaagtatttattgttttatttaagaaaagtttcgtgcgatttaaagagttgagaatttttttatttcgattttcgatttttaggatagtattattggcgtttgttttttgggtttagaaaattttttttacggagtcgtttttcggcggtgtttagtttttcggatattttcgagatattttagatggttttagttcggtggcgaagggagggtgtaggtcggtatttaggagacgtgggggtgaggagagcgtttttttgggtttcgttttgtgatcgtaggttgttttagttatttttttgtgttttttttagtatagcgtttagcgaagtggggttagtcgtcgcgtttatttaggggtttgttttggggatacgtttttgtttttggggagttttggtcgtcggggagtgggcggttagcggttgtattaggcgggagcggttaataggaggttgcgagggtttcggaatttcgttggtgggagtaggtgttttttgtgtattttttttttaaaattattttggtcgttagatggttgtgggtcggtattttatttatttatttatttatttatttatttatttatttatttatttatttattttgggtattgggtttggagtcgggaattttattgatttggttttgtttttaaagaattgaaggtagtgaggtttagtgaagaaggtagtcgtcgggcgtttttaggtttttgttgggttgggtcggggagtttggtcgtttatcggtcgtagcgttggggtttcggcgttttttggtggcggcgttttttttttcgtttttagagttttggttagttttatttttgcgtagttgatgaaattcgggagggcgaaggggttcgcgggaaatttatattcgggtggaggggcgttttggagttcggagattcgattttgcgggagtcgcgcgtagtttcgtttgtttttaaatttggttaaagtaaacgttatcgtttttcgttttttttttttttttttttttttgttataaaattaggtgggtagttggatttaggatttgttttagaagtttgaaaggttcgcgtgggttgagtcgagggcgaattagggatttaggtttggtcgttgtttttttcgtaggcgttttgaggttttagaatagaagttattgtggtatttatggggttatttttttcgttagtcgttcgttaaatatttattgagtatttattatgtgttagatttgggttatatgtttgaagtagtttagaaaaggtattaaacgtttagaagtatatggcgttaagtataagtaattacgtataaaatatttagaaggttattaaatgttaggggaagatggagtagaggaaagtggggtgggagttaggattttaaatagggtggttaaggatttatattttaggtataagttttataattttataattggcgattgaaatttaaaattttggtcgggtacggtggtttatgtttgtaattttagtattttggaaggtcgaggcgggcggattacgaggttaggagttcgagattattttggttaatacggtgaaatttcgtttttattaaaaatataaaaaaattagtcggtcgtggtggcgggcgtttgtagttttagttattcgggaggttgaggtaggaaaatggcgtgaattcgggaggcggagtttgtagtgagtcgagatggcgttattgtattttagtttgggtgataaagcgagatttcgttttaaaaataaataaataaataaatatgtaaataaataaataaatatgtaaatatgtaaataaaataaaataaaattttgtatattttgggggttttcgtatcgtttgtataggtaggcggttattagattaggttattttgatatgtttttagtttattcggttataggggtattttttaaattcgggttagcgaagttttttatttttttttttgtgttttttgtttatgtttatgtttaaaaggttttatttttttttttttgtttggggatttttattttttatagagttttatttttttttgaagtttttagattttgtgtcgttttattaggtaatgtagggtatagcggttttttagggatgttttgttaagtatagtttaaggtgggaggtaggggtttggttgttgagttaaaggtagggtattttttgagttggtatgtgtgttatggtttttagatttttaggtagtatttgtttatttttttttgtttggtttgggtcgtttatttttttagggtttaacggttgggtttgtaagagggtttttagtagggattgaaggtttatattaaatttatgttgtatagtgtgtaattgataaggtgattttaggtggtattttgaaatttataaaatatagatttatgtatttatttttttaaagtaataagaaaaaatataattagtatagtaaaggtagatattttagatattgtttaggttttttttttaatatatggtttaagttttaaaaagtaagttaattgaagttaatatagtaagtgttagtttaggtggttggagatatagtaaaaattttgatagtaatataaatagatttgaaatttgaaaattttttttatatgaagaatattttttgtattatttgatatttttttatcgtaattttttttttgaaataagtatttggttttaaagtgttgaaatataaaattatataagggaggtacgatgttttttttatttgtttgttaggtgaggttggagaacgttggtttaggagcgtttaggttataggaagattgtggggttttatgggatttttggatatttttggttttgttatttttttaggagtgttttttttttagttttcgtgtagttttggagggattttttttaattatttatatttgtttttatttttttggtatttggttttggggtttaggagtagatggtttattttaggaattaggaagttcggtgaggaagataaatttttatcgttttgttgatgttatttgtgtagtaggtatattagttgatatggtggatttggttagtgtgaaattatttggtttagagaaggtttttaggaagatattgaatagtggatttatataggattttagtttgttttttttgaatttgttaatttggtatttttaaagatcgagtttgtagtataagttttattgttttagttttgaagatatggaatttaagtttttatgggttttgagtttaaggtttagagttgagggtttcggttaatatgatagagttaggtaggagtaagggtatatttttttggggttaacgtttttggattttggaatattagttaggttttgaaagtatttttggggatataagttatttttatggtagttatttagggagttttttggaatttcgtatttagggttaggatttggtatttgattagttggttatgttttttttgtttagatttttattggttttaagagttagttgtaaatagttttaggttgttttagagggaaggatttttgggaggtagagttgatttttattggttttgggtatatgtgtgggtaagtaaggtttatcgttagggtatgtgtacgtttagtaggttaggatttttgtttgagtaggttttgtttaaagatttttttgttggatagtgttgaggtagggggatttgagaatgtaagaataataaatttagtttttttttatttttataatataaaatatttttgtgattttagatgtgtgtgtgtgtgtgggggggggggcggggattttttatatataaagttagtagttttttagttgtagatattagttggttgttttttaatttaatttaattttgagatgatttatttggaggtaggtttaggttttatatgttgaggttttagttttataaggttgtttttattttagatattagttgtaagttttgggttgtttttttagtgtttttgattaaatgattataaattagggtttttatgattttatttttgggttttattaatttgttattatagtttatggaatttagggaagtatttatgtttattggtttattaaaaagggtattatgggttgggcgtggtggtttacggttgtaattttagtattttgggaggttgatgtgggtggattatttgaggttaggagtttaagattagtttggttaatatggtgaaattttatttttattaaatatataaaaattaattgggtttggtggcgggtatttgtaattttagttatttgggaggttgaggtaggagaattttttgaattcgggaggcggaggttgtagtgagttaagattatattattgtattttagtttaggtgataagagtaaaattttgttttaaaaaaaaaaaaaaaaggatattatgaaggttataggggaagagatgtatagggcgaggtatgggggaaggggatatgaagtttttatgttttttttaggtattattttttaggaatttttattgtcgtgaagttttttgaattttgttttgttgtgtttgtatagaagtttattatataggtatgattgattatattattggttattggtaatttagtttttagttttgtttttttttttagaggttgatggggtggggttataagttttcgttttttaattttgtttggtttttttgatgattagtttttattttgaagttatttaagggttgttagttattagttaagtaaattaaagattttaggagttgtatgttaggaagttgggataaagattaaatatatattttataatagtatagttggtattttttgggatatttttcgggattgtcggattattagggtttatagggtaaattagatttaaggttttaggggtttagatttgtgtttttagtttttatattagtttttaggaattaagtagtgaattttttttgtgtttagttattatagttaggtttggattttttttgttttttttttttagttttattttttttttttattttttttgtttttgggtagattggatttagtagttggggatttattgaaggtttttatattggagtatatattagtttttatttattagaaattttagagtgtgtatattgagagtgtgaatagtattgatattggagttattttgtgttgcgtgt

SEQ ID NO: 50 - DNA, 8788 bp, Artificial Sequence
  chemically treated genomic DNA (Homo sapiens)
gtacgtagtatagggtgattttagtgttaatgttgtttatatttttagtgtgtatattttggggtttttgataggtaggaattgatgtatattttagtatgagaatttttagtggatttttagttgttgagtttagtttgtttagaggtaaggggaataggagagaggggtggggttaggaaagggaggtagaaggaatttaggtttgattgtggtgattgagtataggaagggtttattatttggtttttgggaattggtgtggggattgggagtatagatttgaatttttggggttttgggtttgatttgttttatgagttttggtagttcgatagtttcggggaatgttttaggaaatattaattgtgttattgtgaaatatatatttggtttttgttttagttttttggtatgtagtttttaaaatttttggtttatttgattgatggttggtaatttttgggtagttttaggatggaggttagttattagaaagattaagtaggattagaaggcgggaatttatagttttattttattagtttttgaggaaggaaatagggttgaaggttaagttattaatgattagtaatgtaattaattatgtttatgtaatgagtttttatataaatataataaagtagggtttagagggttttacgatagtggaggtttttggaggatggtgtttggagagggtatggaggttttatgttttttttttttatatttcgttttatgtatttttttttttgtagtttttataatatttttttttttttttttttgagatagagttttgtttttgttatttagattgaagtgtagtggtgtgattttggtttattgtaattttcgtttttcgggtttaagagatttttttgttttagttttttaagtagttaggattataggtgttcgttattaagtttagttgatttttgtatatttagtagagatggggttttattatgttggttaggttggttttgaatttttgattttaggtgatttatttatattagttttttaaagtgttgggattatagtcgtgagttattacgtttagtttataatattttttttaataaattagtaaatataagtgtttttttgagttttatgagttgtggtagtaaattaatgaaatttaaggatggggttatagaaattttaatttatggttatttggttagaagtattgggaaaataatttagggtttgtaattggtatttgaagtaggggtagttttgtgggattggggttttaatatgtggggtttgagtttatttttaggtagattattttagagttgaattgaattagaagatagttagttggtgtttgtagttgaaggattattggttttgtatgtggggaattttcgtttttttttttatatatatatatatatttgaagttataaaagtattttgtgttgtgagagtaaggagaaattgagtttgttatttttatatttttagatttttttgttttagtattgtttagtaaggaagtttttgggtagagtttgtttagatagaagttttggtttgttagacgtgtatatattttgacggtaagttttgtttgtttatatatgtgtttagaattagtggggattagttttgttttttaggggtttttttttttagggtagtttggggttgtttgtaattggtttttgaggttagtggggatttagataggaaaaatatggttagttggttaaatgttaagttttggttttgggtacgggattttaaaaggttttttggatgattgttatgggagtgatttatgtttttaagagtgtttttaggatttggttgatgttttaggatttagagacgttggttttagagagatgtatttttgtttttgtttggttttgttatgttggtcgaggtttttaattttgagttttgggtttagagtttatggagatttgggttttatgtttttaaagttgagatagtggggtttatattgtaagttcggtttttgaaagtattaaattgataaatttaaagaaggtaaattaaagttttatgtaagtttattgtttagtatttttttaagggttttttttgggttaagtggttttatattgattaaatttattatgttagttaatgtatttgttgtatagatgatattagtaaggcggtgaggatttgttttttttatcgggttttttggtttttggaataggttatttgtttttgaattttagggttaggtgttaaaggagtgagggtagatgtgggtggttgggaggggtttttttaggattgtacgggagttgggagaggagtatttttggaggggtggtagggttaagggtatttagggattttatagggttttatagtttttttatgatttgagcgtttttggattagcgttttttagttttatttggtaggtaagtgaggaagatatcgtgttttttttgtgtgattttatgttttagtattttggagttaaatatttattttaagagggggattgcggtgggagggtgttaagtaatataaaaaatattttttatgtagaaaaggtttttaaattttagatttatttgtattgttgttaaaatttttgttatgtttttagttatttagattagtatttgttatgttagttttaattgatttattttttaaaatttgaattatatattaaaaaaaaaatttgagtaatatttgaaatatttgtttttattgtgttagttatatttttttttattattttaaaaaaataaatatataaatttatattttatagattttagagtattatttgaagttattttgttaattatatattgtataatatggatttagtgtaaatttttaatttttattgggaatttttttgtaggtttagtcgttgggttttggaggagtgaacggtttaggttaggtagaggggggtaggtagatgttgtttaggggtttagagattatagtatatatgttagtttaggagatgttttgtttttaatttagtagttagatttttgttttttattttgaattgtgtttaataaggtatttttgaggagtcgttgtgttttgtattatttggtagagcggtatagagtttgaagattttaggagaaggtggggttttatggggagtaagagtttttaggtagagaaagaaaggtggagttttttgagtataagtataagtaaaggatatagggaaaggggtggggaatttcgttgattcgaatttgagaggtatttttgtggtcgagtgagttggagatatgttaaaatggtttggtttgatggtcgtttgtttgtgtaggcggtgcggaggtttttagagtgtatagggttttattttattttatttatatatttatatatttatttatttatttatatatttgtttatttatttatttttgagacggagtttcgttttgttatttaggttggagtgtagtggcgttatttcggtttattgtaagtttcgtttttcgggtttacgttatttttttgttttagtttttcgagtagttgggattataggcgttcgttattacggtcggttaatttttttgtatttttagtagagacggggttttatcgtgttagttaggatggtttcgaatttttgatttcgtgattcgttcgtttcggttttttaaagtgttgggattataggtatgagttatcgtgttcggttagggttttaaattttaatcgttaattgtaaaattgtgaggtttgtatttaaaatatggatttttggttattttatttaaaattttaatttttattttatttttttttgttttatttttttttagtatttaatggttttttaagtattttatgcgtaattatttatgtttagcgttatgtgtttttaaacgtttagtgttttttttaaattattttaaatatgtagtttaggtttagtatatagtgggtgtttagtaagtatttaacgaacgattagcggaagggatggttttatgggtgttatagtagtttttgttttggggttttagggcgtttgcgggaggggtagcggttaggtttgaatttttggttcgttttcgatttagtttacgcgggttttttaggtttttgggatagattttaggtttagttgtttatttgattttgtggtaaagaaaaaaagaagaagaagaagcgagaggcgatggcgtttgttttggttagatttaagggtaagcgaggttgcgcgcggttttcgtagggtcggattttcgagttttagggcgtttttttattcgggtgtagatttttcgcggattttttcgttttttcgggttttattagttgcgtaggaatggagttggttagagttttgggagcggggagggaggcgtcgttattagagggcgtcggagttttagcgttgcggtcggtgagcggttaggtttttcggtttagtttagtaaaggtttggggacgttcgacggttgttttttttattggattttattgtttttagttttttaagagtagggttaagttagtggggttttcggttttaagtttagtgtttagggtgggtgggtgggtgggtgggtgggtggatggatggatggatggatggatggagtgtcggtttatagttatttaacggttaaagtggttttggaaaaaaaatgtatagaagatatttatttttattagcggagtttcggagttttcgtagttttttgttgatcgttttcgtttaatgtagtcgttgatcgtttatttttcgacggttaggattttttagggatagggacgtgtttttagggtaggtttttggatggacgcggcgattgattttatttcgttggacgttgtgttgggaaggatatagagaggtggttggggtagtttgcggttataaagcgaggtttaaaggggcgttttttttatttttacgttttttgggtgtcgatttgtatttttttttcgttatcggattggggttatttgggatgtttcgggggtattcggagggttaagtatcgtcgagggacggtttcgtgggaagagttttttggatttagaaggtagacgttagtagtattgttttaggagtcggaggtcggggtgggggagtttttagttttttgggtcgtacggagttttttttgggtaaggtagtaagtatttaggtttaaaggatttatttatagttattatttattgagtattgtttgtttgttagatacgatgtagagaatttcgcggcgtggggcgggttttattgaatttttcgttttatttcgcggggtgggtttgtgattagtttattttattattgagaggtcggaagtataaaggttatattcgtttttattgagagtcgtcggcgttttttgttttgtttgtataggcgaggaaattgaggttcggttggtggcgtcgtgggtttggagttcgagttacgttgattgtaaagacgggttttattttcgtagatcgagttttgtcggcggttgcgtcgtaagtcgggtaggtggcgagtttgagtttttacgtatagaaagtaggattttttcggttgttttgggtcgttatcgttagtaggtttttcgttcgggattaatttgtttgttttttattggtttttatttagttttcgttatcgaaaggtttcgtttcgtagttttttacgcgcgttttattttacgtttaaggtttttagtttttttagtggggttttgttatagggataataagcggttttttagtcggcgtcgtttaggttgcggattttattgtagatcgggttagcggtgcggggtttagcggagtttgagaaggttaaaggtcggagcgtattgcgtttcgggagtatagagggagcggaggaggggcgaaggggatgggtggggggtgtcgtcgagggagtcgcgcgttagagatttcggttacggttagtattcggtttcgggttcgttttttatcgcgcgtttcgtttcgtttcgtttggtttttttttttaaagcgttcggcgcgcgttttttatcgtcgtatttttatttttcgttagtcgtattgttcgttcggcgttcggttttcgattcgcgttcgttcgttcgttcgttcgttcgttcgcgttatgaacgttaaggtcgtggtcgtgttggttttcgtgttgatcgcgttttgttttagcgacggtaagtgcgttcggcggggaggttttggcgaggttttgggtttcggttttcgttcggcgtagagtcgcggtttttttgtttgcgttcgtagtttgcgtcgttcgatatagtgggggtggaggtagttcgtttagttgggcgttttggtgcggtgtcgcgtttaaagttttatttttgcgtcgagggtttgtgatttgtagagagcgatcgtttgattttaagttggttgtagagcgaggttagtcgggataattgggtaggaacgttttaagagagcgttcgggattggcgcgggaaggcgcgagggtggggagtcgcggattttagatttttgtttgtttattttttatttattgttttttcgttgcgggttcggtttttataggcgaatgggtttcgaggttttgttgcgtatagtgttggaggtcgggcggtgtatggcgagagcgcgttttgtaaagttcgttttatgtcgcgatttgaggttgtgaggttcgatgtagtcgcgtagttttcgttttttgcgaagtcgattttttttttatattttcgcggggtttttggttaggcgcgggcgggttgcgcggcgtagttgtcgggtttgtgttattcgttaggtcgcgtttttgtatagtttcgcggttcgtagcgacgcggatttgggcgcgcgtttagtcgttgtttttttgttttttttcgggtttatttgagagaggtttagggatttttcgagttttatacgttttttttttagttttttaaatatatttgtagataggtttttttgttattagttggttaagcgttttgttttagaatgagagttgtagtaaagtttaatttttaaggttttgggttattgggaatcgtggtgtttcgttttattgggagagggttttttttttttttttcgttgaagagaaattcgttgcgttgttataggatatcgatgtaaattaaaataaattgttgtttttgaatatataaaataaaattttgtggtttaggtcgttgagtttttttggttgtgaagttttttgtaaagagttgaaggatattttgagtgtttttgtagtcgcgggttgtgtaggtttagcgcgtttcgagtttttggttgggttggtgtagacgtggtttcggcgttttagttggtttggattgtgcgttggtgtgagtaggattagcgtagttgagtcgggttggagaagttgggtagtttggggtcgtggcggattgtttaagtgttaaggatatagattgaaggtaattgggaatgttcgtcgttgatgaaaagtttttgaggttgtgtttgtatattgattttttttttttttcgtaagttatggggtatgtttttagtttttattgttggatatttttttgtttttgtaaggtttttggtttgggtagttattgattgattggtgggatgagcgcggaggtgttatagtgcgtcgttttgggaaatggtgttgtttttttttcggagggttggagagaggattggaatgaggaatttcggtttttgagttatgggtgtaattgatttgggggaagtatagagacgtggggtttattttagattttttttggtttgggaagggtgatatggtttttagagttgttttattggtagttaagtaattagggtaggagtttgggttttaggtagatttgttttttatatatatcgttagaatgttttgttttgttttgttttttttttattttatagtgtttatgtgttttttatttttatatttagtttttaagttgtattatagagagagtttggttaggggttttgttttttttttattggttgattttcgttaggtagttgggtttttgggtttttcgggtttaaatttagggtgggttttttttttaagtttgtttggaggggttagttgggtttttgtttttgtattagattggagggttttttgaaaatttttggagttaagtttattcggttttaaattcggggtattattagagttagttaggatttttgtcggtatacggatttatatttagaacggttgggaaagttagttttattgataaaaagttggaggaaggagtatatgaggtatatacgagattatgtttttttggtaagtatatttgggggttttgttattttaaaaagatttgttgaaattcgttgtttgataggcgggttttaggttttgggagtagaagtaagaattgtttttgaaggaaatggataattttagggggtggagggggagaggagagagagtttgtgtgttgagttttgaataggttttgatttttggttttattattattgtttggttggggggttagaggagttttttttttttgggcgttggagagttatagttttatttattttagcgggggcggttgtagtatttgtttttggttgtatatttttaagtttattgttgtcgggagggggtttgtgttttattatcggttttttatttttttgttttatttttaatttattttttgttttagtttggaagggtttaaaagaaatttagggaaatttggaggtataatatttaggagcgtttagttttttagttatttaggttgtaggtttcggt

SEQ ID NO: 51 - DNA, 13114 bp, Artificial Sequence
  chemically treated genomic DNA (Homo sapiens)
cgggaaaggggttagggtatagaagtaagggattggggtgtagagataagaggtcggggtgtggaaataagggatcggggtgtagagataagacgttagggtatagaaataagggatcgggggatttttgttttttagaaaagcggtatttgttattaagggtgaaggagaaggggttggggggtttttgtttttttagaaaagtagagaaggggtagagatatagagaaggagttgggggtttttgtttttttagaaaagtagtatttgttattaagggtgaaggattaaggtaggtatttttatgtggttagatatttttgaaacgtgggtgaataattagagaggtgtttttgcgtgattaaatattaagggaaggttgttttttcgagtttatgatcggcgttggagttttgggtttacgaataaagcgcgttttttgtttttattagaaaaggaaaggaattgaaattaagagaagggagagattgaagagtggaaaggagaaagtggttgagggatagtgagagaggttggagaagagagtaaaaagaggttgtttattggatttaaaattggtgagatgttttttgggttggttggtttgaggacgagaggtcgtaggtggattttttttatggagtaaagagtaggaggataggggattgattttttaaggaagattttttgattcgagttatggtattaaattttatttacgttcgtgtgaagagattattaaataggatttgtgtgagtaataaggttgtttattttatttgggtgtaggcgggttgagtttagaaagagagttagtaaagggagataggagtgcggtcgttttataggatttgggtaggtaaaggaaaattatagttaaaagggggttgttttttggcgggtaggagtggggtttataaggtgtttagtaggggagtttttgagtcgggatgagttaggagaaggaattttataagataatgttattatttaaggtaagaataggttatttttatttttttcgtggtggaatgttattagttaaggtaggaatcggttatttggatgtgtatatataggttatagggggatatgatggtttagtttgggtttagaggtttgatagtttggattatttgatttggtgattcgtatatttcggttttttaaagtgttgggattataggtatgatttattgtatttggttttagaaaattttttaaatattaaaatgtatgttatgtgtattttgttataatttttgaaaagtattttttggtgtttagagatagaagatgagtggttgtttagggtcgggagagtgaggggatcgtggtgatgggtagttggtcggtatggggttttgaagggtagtgatgataatattttaaaattagattgtgttgacggttgtattaatttcgtgaatattataaaatttaaattattgaattatgtatttttaatgggtaattgtatggtatgtaaattatattttaataaagttatatttttaaatattaaaaaaaggtcgggtgcggtggtttacgtttgtaattttagtattttgggaggtcgagaagggcggattacgaggttaggagatggagattattttggttaatatggtgaaattttatttttattttgaaaaaaaaaaaaaaaaaaaaaagattattcggacgtggtggtgggtatttgtagttttagttatttaggaggttgaggtaggagaatggtataaattcgggaggtagagtttgtagtgagtcgagattgcgttatttaggaggttgaggtaagagaatggtataaatttcggaggtagagtttgtagcgagtcgagattgcgttattgtattttagtatgggtgatagagtaagagtttattttaaaaaaaaaaaaaaaaagattagtaatattttttgtgttatttattatttaagtgattgaattacgatttgaaatttattattttaaatatggtttagagtttgtagaggggggatagttttaggaatgttggtgtgggtttaaggttgaattaaatagatttagatggtttatatttgtaattttaatattttgggaggtcgaggtaggtgggaggttgaggtaggcggattattggagtttttggagcgaagaaaggatgttagtggaaaaattggtgaaattagaataaagtttatagttttattttttaaaggaggttgggcgtggtggtttatgtttttaattttagtattttgggaggttgaggtaggtggattagttgagtttaggagttcgaaattagtttggttaatttgacgaaattttatttttattagaaatataaaaattagttgggcgtggttgtgggtgtttttaattttagttatttaggaagttgaggtaggagaattgtttgaatttaggaggcggaggttgtagtgagttgagattatattattgtattttagtttgggttatagagtaagattttatttttaaataagagagatatgataattaaataaattgtgtaattttggattaaattttaaattaaatatatgttattggtaaaataagtggtgaaatttgaataaagtggatagattagataatagtgttatattagtgttattttttgattttgaatattaataatagaatgtttttggttttgggaaatataatttgaagtgattagaggtttagggtattatatgtaaattagatatatttttttcggggagagagggagagggagagaggttgaatgatgaagtaaatgtggtaaaatgttaattttggggaaatttggatgaagaaattatagattttttttttttttatagatagggtaatattttgttatttaggttagagtgtagtggtacgattatggtttattgtagtttttatttttttgggtttagatgatttttttattttagttttttaagtagttgggattataggcgtatagtattatatttggttaatttttgtattttttttttttttaggttcgttttaagtaatttatttatttcggttttttaaagtgttgggattataggtgtgagttattgtatttggttagaaattttttaaattatttttgtaagtttggaattatgttaaaattaaaagtttaaaataataaaagataatatttttatatttttttggtgaaggtaattatgttatggttgagagggtggttgaggtttgaggatttagtttatataagttttttttatagagggtatttaagcgtttcgtagggggaaggataaagaaaatatttagagttatgatagttgtgtaaggggaaacgttagtatcgagtattgaatttttagtaaataagaaggaggcgggttgggtgtggtggtttacgtttgtaattttagtattttgggaggttaaagtgggttgattatttgaggttaagagttcgagattagtttggttaatatggggaaattttgtttttattaaaaatataaaaattagtcgagtgtggtggtatacgtttgtaattttagttatttgggaggttagaataggagaattgtttgaatttaggaggtgaaggttgtagtgagttgagattgtattattgtattttagtttgagggatagagtgagatttcgttttaaagagaaaaaaaaaagaattagtatatttgtttgttttaagaagatataattagttttgtatagtagttatatgtatttattaggatatattttaaggttttagtggatgttgaaaattatatagtattttatatgtatatatatatgtatatatatatatatatatatacgtatatgtatatatatatgtatatatgtatgtatgtatatatatatatgtatatatatatatatgtatatatatatgtatgtatatatatatatgtatatgtatgtatatacgtatatatgtatgtatatacgtatatatgtatgtatatatatatatgtatgtatatacgtatatatgtatgtatatatatatatgtatgtatatacgtatatatgtgtgtatatatatatatgtatgtatgtatgtgtgtatatatatatatatgtgtatatatacgtatatatatgtatgtgtatatatgtatgtgtatatatatatgtacggtattatgtagtatatatatatatatatgtatatatgtatatatatatgtataaatgtatatatgtgtatatatataaaaggtatatatgtatatatgtgtgtatatataaaatgtatgaatttttttttttttattgtagattttaataatttttgtatagaatttttttttattaagtggagagttagttatttatttaaaagaaatgttttttggttgggtgtggtggtttatatttgtaattttagtattttgagaggtcgaggtaggaagatttatttgaggtgaggagttggagattattttggttaacgtggtaaaaatcggtttttattaaaagtataaaaatgagttgggcgtggtgttgggtgtttgtagttttagttatttaggtggttgaggtaggagaattgtttgaatttataaggtagaggttgtagtgagttgagattatattattgtattatagtttgggtaatagagtaagattttgttttaaaaaaaaaaaaaaaagaaagaaaaagaaaaagaaaagaaatgtttttttttttattaagttttttaaatgaaaagtttttttttttatttttattttattgaaatattataatattatttttgaagaagttagtgttattattttattttgatgaaattaattaatttatttaagtatatgtatattgtatatagagaagttaacgttaaaatttttatttttatttttttagatttagtagatatatgtgtaggttttttatgagtatattgtatgatgttgaggtttgtattaatgatttagttattaaataggtagatttttaagttttgtttttttttttatttaatgtttagcgtttttatttataagtgagaatatgtggtatttggttttttttttttttttttttttttttttgagatggagttttatttttgttgtttaggttggagtataatggtattatttcggtttattgtaatttttattttttaggtttaagtaatttttttgttttagtttttcgagtagttgggattataggtatgtgttattatattcggttaattttgaatttttagtagagatagggtttttgtatgttggttaggttggtttcgaattttcgatttaaggtgatttatttgttttagttttttaaagtgttgggatgataggcgtgagttatcgtgtttggttagtatttggttttttgtttttgtgttaattcgtttaggataatggtttttagttgtatttatgttgttgtaaaggatataattttgtgattttttaaggttgtatagcgttttgtggtgtatatatattatattgtttttatttagtttatttttgatgggatttgggtggattttatgtttttattattgtgaattttgttgtaatgaatatataagtgtatgtgtttttttggtagaatgatttatttttttttggttatatatttagcgatgggattgttgggttgaatggtaattttgtttgtagttttttgaaatatttttaaattaaattgttttttatagtggttgaattaatttatatttattaatagtgtataagtgttttttttgttttataattttattagtatttgttaatttttggttttttagtaatggttattttgattggtgtgagatggtattgttgagggataatttaggaattagagagatcgaggggttgaggaggatttattattattattattatttaggtgtatcggttttagttagattaatatttaaaaagattgaggttcgaatagagagttcggttattttttaagtattttgtggggttgggggagatttgtgtagggggaagtatattatagaagtaagaaataaaggtagttatttaattgagatatgtattatattattttttattttttaagaaaaatatgttttacgatttgaggttattttgtttagtgattttgtagtcgtacggtaagagaaatagggtttttataatgtttgggaaagggagagataaggtttattagttatagatagaaaaataggtagtttatgtttaaaggattttatttttttttttttttcggggggaattgggtttttttaaatataattgagtttttgtttatatattttgtaattttttttaatttttgttttagtattttattgtgaaattttttatgtttttatacgatttttagggggttttttttgggtatgattgggtataattttttatagttagttttgggtacgatttttatattgtagaattgagaagttgatttagaaatgtattttgggttgagtagataattgttagagttgttggttagattatagatgtgttagagggattacggtttttttgtaagtttatggttagaggcggaggggagttgtgaacgttttgatgaaagtagttaacgtgaaagcgttttggtgatgggcgttggtgtttatttattattttttgtgtatttatttttttggttcgttcggtttagtttttattgtttagtattaggtcggtagaatttgagcgatgttttttatattttttgttttgttttgcgtcggtgagttttggcgtggaaggggaatgggattacggtgtgtttgggaggtaataggttttattattttcgttttttagggttgtgtttgagttagaggattagcgtttagtagcgtgagttttttttttaaagtttagggttattttttcgggtttaggttaagttttttttatttaagtacggttggggagaggggatagggtgttggttttttaggagagtttggggttagtagttgggtggagtttaaggttggggggagggggtttcgttggaattttagtttttgatttttttttagagatttttttaaaatcgtttatttgggtcgagttttattttatggttttaaaggaaaagtaagtgattatttgttgttagggaaattatggggttgttgaatattagttgtattttgaaggaagtttttttgtcgtggatagattaaaattttttgagcggattaataaagttaaattttatatttcggatatgaattttcgtatggtagggtaatatagttgtatttatcgggttggggagttttggttagagtttagtaatttgttggatttggtggtaataggtaattgttcggttttttaattggagagtgattttagtttgtattcgggatgtagtattatttatgaatttttttaagttttatttagatattgtttgtttcggtaggaggttggaaggaggggtgatttttattataatttttgtttataaggggttgtttgtagatcgtgtttttacgttttaggagtagatgtgtttttagttagtttttttatgatatagattttgagatagatatttgtatgtaggggtatgattgaggaatgtttttaaaaataatgtttgtgggttaggcgtagtggtttatattttgttttttttatttattataggtggtgggttttttttttttttatttgttttgagacggagtttcgtttttgttatttaggttggagtgtagtggtgtaatttttagttattgtaatttttattttttgggtttaagtgattttttagttttagttttttaagtagttgggattataggtatttattattacgttatattttgtatttttagtagagatggggttttattatgttggttagggtggtgtcgaatttttgattttagatgattcgttcgttttatttttttaaagtgttgggattataggtgtgagttattatatttagttaggtggtggttttttaaaaaaaaaaaaaaaaattagttttttttttttttaataatatggttgtttattattattattaagtattatatatagttatatatatatatataattgtatgtgttatataattaggtttgtttatattagtaatattaaaaatatatgagtaatattttgtgttaggaaggttatgatgttattaggtaataggaattttttagttttattataattttatgggattattattatatatgtggtatattgttggttaaaatgttattatgtagtttataatagtattttatgtttatttaaatatttttttttgtgaaatgtttatttaaattttttgtttatttttaaattgggttgtttatattttgattgattaggaaaagttatttttatattttgtgttatatatttgtgttgaaatatatatattttttgtttgtgtttttttatttgtttagggtttttggattttgtttggaggttttggtaggggaatatagttatttatttatttttttttttttaatttttttagtatttattgattatttttgggtgtttttcggagagggggatttggtagggttataggataatagtggagagaaggttagtagataaatatgtgaataaaggtttttggtttttttaggtagaggtttttgcggtttttcgtagtgtttgtgtttttgggtatttgagattagggagtggtgatgatttttaaggagtatgttgtttttaagtatttgtttaataaagtatattttgtatcgtttttaatttatttaattttgagtggatatagtatatgttttagagagtacggggttgggggtaaggttatagattaatagtattttaaggtagaagaatttgttttagtatagaataaaatggagttttttatgtttatttttttttatatagatatagtaataatttgattttttttttttttttttatattttttttttttttattcgataaaatcgttatcgttattatggtttatttttaatgagttgttgggtatattttttagacggggtggcggtcgggtagaggggttttttattttttagacggggcggtcgggtagaggcgtttttttattttttagacggggtagtggtcgggcgggggttgttttttaatttttcggacggggcggttggtcggggttttttttttttttttttgagatagtttcgttgtagtgtagtggtataattttagtttattgtaatttttgttttagttttaatttttttgttttagttttttaagtagttgagattataggtatgtgttattatattcggttaatttttgtatttttagtagagacggggttttattatgttgattaggttggttttaaatttttgatttaggaggtcgagtttttagtaagtaaagatagtgttacggcgttttagtttgggaaatagagtaagattttgtattatttttaaaaatggttttagacggtaaattttttattgtgtgtatttgattaaaataataattaaaaaaaaaaaaaaagttggttgttaggtatggtggtaggtttttgtagttttagttatttgggagggtgaggtaggagaaacgtttgaattcgggaggtagaggttgtagtgagttaagatcgtgttattgtattttagtttgggcgatagagagagattttatttttaaagaaagaaaaaaaaaaatagttggttgtttattattgagtttttggtgtggtggttttatttttttttatagaaatgtatgatatatttattttttcggtttattttggattcgaagtgatttcgggagagaaggtgattttttattgtcgtttagatattgtaataagtatgtttttattgtttaaggagggaagatttagttacgtatagcgcggatacgggaaggtttaggcggagttttttttgggttttgtgattatagtttatcgagggatatatcgatgttttggtttttataataattatgtttggtttttttttagtgagttagtgaagtttttggttataggtgaggaaatgtttaattttttatatttttcgtcgttatgttttatttggagttttgagggatttttagagagtgatggggagggtgtttaagggacgtttattttttgggtgtttggttggttatgtgaggaagaatattagaagtaggaaggaggagggagtagagaaaggaatggtaaggcgggtggattataaggttaggagttcgagattagtttggttaagacggtgaaatttcgtttttattaaaaatatagaaattagttagacgtagtggcggatatttgtagttttagttatttaggaggttgaggtaggagaatcgtttgaattcgggaggcgggggttgtagtgaatcgagattatattatcgtattgtaatttgggcgatagagtaagattttattttaaaaaaaaaaaaaaaaaaaaaaagaatggtaagatcggaggaaattaaaaatttttatttttttttttttatttttttttttaggcgatattgagaatattagttttgtatttgaagattttattttttttggtgagtaattggtttttttaagtttagacgagcgattagagttttttagtgatattaaaaacgtggtatttatttaaaatatttatcgaggttaggcgtggtggtttacgtttgtaattttagtattttgggaggtcgagatggtgtattatttgaggttaggagtttgagattagtttggttaatatggcgaaattttgtttttattaaaaatataaaatttaggttgggtattatggtttatatttgtaattttaatatttcgggaggttaaggtggttggattataaggttaggaattcgagattagtttgattaatatggtgaaattttatttttattaaaaatataaaaattagtcgggtttggtggtgttcgtttgtaattttagttatttaggaggttgaggtaggagaattgttgaatttgggatgtagaggttgtagtgagttgagatcgcgttattgtattttattttattgtacgatatagcgagattttattttatagaaaaataaaaataaaattattatatatatatatttattaagtgtatagtatatatagtgaattatattgtaatagttagttaggtagatattttgattttgtagtatttagattttagtaggaggagatatattatcggttaacgttaggatagtatataggagggaatgatgttatggaaggaaaagataaagtagaatagatttatagtgattgaaatggtagttagtaatattaaataggtttgtttagatggattttatagagaaagaaggtatttgagtaaatgcgtttagatttgagttaattatgtggttgttaggagaaaggaggttttggagagaatgaaatggtatttgtttgtgttttggggtaggaagataattggggtaatataataataattatgaggttaggagggttgaaaatgatgtttggaagatgacggtgggatgggtttggggcgtacggttaggattataggagtgaggttcggcgcggtggtttacgtttgtaattttagtattttgggaaatcgaggtaggtgggttatgaggttaggagattaagattattttggttaatacggtgaaattttgtttttattaaaaaaaaatataaaaattattcgggcgtggtggcgggcgtttgtagttttagttatataagaggttgaggtaggagaatggcgtgaattcgggagacggagtttgtagtgagttgagatcgcgttattgtattttagtttgagcgatagagtgagatttcgttttaaaaaaaaaaaaaaagaaaaagaaaaagaaaaaaaaatagtgagattttgaattttattatgtgtgtatgtgtgaggagaaagaggtaatgatgatttaatgaggaaaatgaggtttaaatagaagacgggttgggtcgggtggttttcgtatgtaattttagtattttggaaggtaggggcggttggattatttgaggttaggagtttaagattagtttggttaatatagtgaaattttatttttattaaaaatataaatatgagttgggtgtggtggcgtacgttagtaattatagttattcggggttgaagtaagaggattgtttgaattcgggaggcggaggttgtagtgagttgagattatattattgtattttagttttagaggtttgttattttagttttttgggaggtcgaagtaggtaggttatttgaggttgggagtttaagattagtttggttaatatggtaaaatttcgtttttattaaaaatatgaaaaaaattatttgggtatgtggtgtgtgtttgtagttttagttattttagaggttggaatatagtgagattttattttaaaaaaaaaaaaaatagaagatatgattggtgtaaagatatatgtttataagtgttagaatggaatttttcgttaggttcgtttatttgtggatttttttattttatttgttggatgaagtttttgggattcgtagggtgaggtgggattttgtaaagttgtagaacgttatggggtagatttaagggaaggagtgttggggtggaggaggttaaaattatttttttttttttattttttttattattagtagatatttggggtatttattttttaattatagagacgggattttagaaaggtaagtagatagttggggttataggttttgaaggaaggggttgggtatagagtagatttaggaagggaatttaaatgggaataagagggtgtttttggttaggcgtagtagtttatatttgtaattttagttttttgggaggtcgaggcgggtagattatttgaggtcgggagtttaagattagtttggttaatatggcgaaattttatttttattaaaaatataaaaaaattagttaggcgtggtggcgtgtgtttgtagttttagttatttgggaggttgagataggagaatagtttgaatttaggaagtggaggttgtagtgagtcgagatcgtgttattgtattttagtttgggcg

SEQ ID NO: 52 - DNA, 13114 bp, Artificial Sequence
  chemically treated genomic DNA (Homo sapiens)
cgtttaggttggagtgtaatggtacgatttcggtttattgtaatttttattttttgggtttaagttatttttttgttttagttttttaagtagttgggattataggtatacgttattacgtttggttaatttttttgtatttttagtagagatgggatttcgttatgttggttagattggttttgaattttcgattttagatgatttgttcgtttcggttttttaaagggttgagattataggtgtgagttattgcgtttggttaaggatatttttttgtttttatttagattttttttttaggtttattttatgtttagtttttttttttagagtttatggttttagttgtttatttatttttttggagtttcgtttttgtggttaaaaggtaggtgttttaagtgtttgttgatgataagggaagtgaagaaaagaggatggttttgattttttttattttagtatttttttttttgggtttattttatgacgttttgtagttttataaggttttattttattttgcgggttttaggagttttatttagtaggtaaagtggaagggtttatagatggacgaatttgacgaggaattttattttagtatttgtgagtatgtgtttttgtattagttatgttttttattttttttttttttgagatagagttttattgtgttttagtttttggagtagttgggattataggtatatattatatatttaggtaattttttttatatttttagtagaaacggggttttgttatgttggttaggttggttttgaatttttaattttagatgatttgtttgtttcggttttttaaagggttgggatgataggtttttgaggttggagtatagtggtgtgattttagtttattgtaattttcgtttttcgagtttaagtaatttttttgttttagtttcgagtagttgtaattattggcgtgcgttattatatttaatttatgtttgtatttttagtagagatggggttttattgtgttggttaggttggttttgaatttttgattttaagtgatttagtcgtttttgttttttaaagtgttgggattatatgcgggagttattcggtttagttcgttttttatttaagttttattttttttattaagttattattatttttttttttttatatatatatatatagtgaaatttaaagttttattatttttttttttttttttttttttttttttttttttttgagacggagttttattttgtcgtttaggttggagtgtagtggcgcgattttagtttattgtaagtttcgtttttcgggtttacgttatttttttgttttagttttttgtgtagttgggattataggcgttcgttattacgttcggataatttttgtatttttttttagtagagatagggttttatcgtgttagttaggatggttttgattttttgattttatgatttatttgtttcggttttttaaagtgttgggattataggcgtgagttatcgcgtcgggttttatttttgtaattttagtcgtgcgttttaggtttattttatcgttattttttaaatattatttttaatttttttggttttatagttattattgtattattttagttatttttttgttttagggtataggtagatgttattttattttttttagagtttttttttttttgatagttatatgattaatttaagtttgaacgtatttgtttagatgttttttttttttgtgaggtttatttggataaatttatttaatattgttagttgttattttaattattgtaagtttgttttattttgttttttttttttatagtattatttttttttgtgtgttattttgacgttgatcgatggtgtgtttttttttgttagaatttaagtgttgtagagttaagatatttgtttggttgattgttatagtgtagtttattgtgtatattatgtatttgatgaatatatatatataatagttttgtttttgtttttttgtgagatggagtttcgttgtgtcgtgtagtggagtggaatgtagtggcgcgattttagtttattgtaatttttgtattttaggtttaataatttttttgttttagttttttgagtagttgggattataggcgagtattattaggttcggttaatttttgtatttttagtagagatggggttttattatgttggttaggttggtttcgaatttttgattttgtgatttaattattttggtttttcgaagtgttgggattataggtgtgagttatgatgtttagtttaagttttgtatttttagtagagatagggtttcgttatgttggttaggttggttttaaatttttgattttaaatgatgtattatttcggttttttaaagtgttgggattataggcgtgagttattacgtttggtttcgatgaatattttgaatgaatgttacgtttttagtgttattgggaggttttgatcgttcgtttgagtttagaaggattagttatttattaggaaaggtggggtttttaggtgtaaggttggtgtttttaatgtcgtttggaaaaggagataaagaaaaaaaagtaagggtttttggtttttttcggttttgttattttttttttttttttttttttttttgagatggagttttgttttgtcgtttaggttgtagtgcggtggtatgatttcggtttattataattttcgtttttcgggtttaagcgatttttttgttttagttttttgagtagttgggattataggtgttcgttattgcgtttggttaatttttgtatttttagtagagacggggttttatcgttttggttaggttggtttcgaatttttgattttgtgatttattcgttttattatttttttttttgttttttttttttttttgtttttggtgtttttttttatatgattaattaggtatttaggaagtggacgttttttggatattttttttattattttttggggattttttagggttttaggtaggatatggcggcgaagggtgtggggaattgagtatttttttatttgtgattaggagttttattggtttattggggaaagattaggtatggttgttataggagttaaaatatcggtatgtttttcggtgggttgtggttatagggtttagggggaatttcgtttggattttttcgtattcgcgttgtacgtggttggattttttttttttgagtagtaagaatatgtttgttgtagtgtttagacggtagtagaaggttattttttttttcgagattatttcgggtttaggatgaatcgagagggtgggtgtgttatatatttttatgagagaaggtggggttattatattagaaatttagtgatgagtagttagttatttttttttttttttttttagagatggagtttttttttgtcgtttaggttggagtgtagtgatacgattttggtttattgtaatttttgtttttcgggtttaagcgttttttttgttttatttttttaagtagttgggattataggggtttgttattatgtttggtagttagttttttttttttttttaattattattttggttaaatatatataatagaagatttatcgtttaaaattatttttaaaaatgatatagggttttgttttgttttttaggttggagcgtcgtggtattatttttgtttattgaagattcgattttttgggttaggagtttgagattagtttggttaatatggtgaaatttcgtttttattaaaaatgtaaaaattagtcgggtgtggtggtatatgtttgtaattttaattatttgggaggttgaggtaggagaattgaggttgaggtagaggttgtagtgagttgagattgtattattgtattgtagcgagattgttttaaaaaaaaaaaaaaaaagtttcggttagtcgtttcgttcgggaggttggggggtagttttcgttcggttattgtttcgtttgggaggtgggggggcgtttttgttcggtcgtttcgtttgggaagtgaggagtttttttgttcggtcgttatttcgtttgggaggtgtatttaatagtttattgagaatgggttatgatgacgatggcggttttgtcgaatagaaaaaggggaaatgtggggaaaagaaagagagattagattgttattgtgtttgtgtagaaagaagtagatataggagattttattttgttttgtattaagataaatttttttgttttgggatgttgttaatttatgattttatttttaatttcgtgttttttgaaatatgtgttatgtttatttagggttaaatggattaagggcggtgtaagatgtgttttgttaaatagatgtttgaaggtagtatgttttttaagagttattattattttttaattttaagtatttagggatataaatattgcggaaggtcgtagggatttttgtttaggaaagttagagatttttgtttatatgtttatttgttgattttttttttattattgttttatgattttgttaaattttttttttcgagaaatatttaagaatgattaataaatattaaaaaaattaaaaaaaaaagaataaatgagtagttgtgtttttttgttagaatttttaaataaggtttaaagattttgagtaaatgaaaaggtatagataaaaaatatatatattttaatataagtatatgatatagaatatagaaataattttttttaattaattaaaatataagtaatttaatttaaaaataggtaaaagatttaaatagatattttataaaagaagatatttgaatggatatgaaatattgttgtgagttgtataatgatattttggttaataatgtattatatatatgatggtggttttataagattataatgaaattgaaaaatttttattgtttgatgatattatagtttttttagtataaagtattgtttatgtgtttttggtgttgttggtataaataaatttaattgtatagtatatataattatgtatgtatatgtaattatgtataatatttgataataataataaataattatattgttaaaaaaaaaaaaagttaatttttttttttttttttagaaaattattatttggttgggtgtgatggtttatatttgtaattttagtattttgggagggtgaggcgggcggattatttgaggttaggagttcgatattattttggttaatatggtgaaattttatttttattaaaaatataaaatgtggcgtagtggtgggtgtttgtgattttagttatttgggaagttgaggttggagaattatttgaatttaggaggtggaggttgtagtgattggagattgtattattgtattttagtttgggtgataagagcgaaatttcgttttaaaatagataaaaaaaaaaaaaatttattatttgtgatgggtgagggaagtaaagtgtaagttattgcgtttagtttataggtattgtttttgaggatattttttagttatatttttgtatataaatatttattttagaatttgtgttatggagaaattgattgaggatatatttgtttttaggacgtagagatacggtttgtagataattttttgtaggtaaggattgtgatggggattatttttttttttagttttttatcgagataagtagtgtttgagtggggtttggaagagtttatagatgatgttgtatttcggatgtagattgagattattttttagttagagaatcggatagttatttgttattattagatttagtaagttgttgggttttgattagagttttttaattcgatagatgtagttgtattgttttgttatgcgggagtttatgttcgggatgtagaatttgattttgttaattcgtttagggggttttggtttgtttacggtaaaaaggttttttttaaagtgtagttggtatttaatagttttataatttttttggtaatagatggttatttgttttttttttggaattatgaaatggggttcggtttagatgaacggttttgggagagtttttggaagggaattagaggttggagttttagcggagttttttttttttaattttaggttttatttagttgttggttttaagtttttttgggaagttagtattttgttttttttttttagtcgtgtttgggtggaaggagtttggtttgaattcggaagagtgattttgggttttgaaggaaggatttacgttgttgggcgttgattttttgatttagatatagttttggaagacgggagtaatgagatttgttgttttttaggtatatcgtgattttattttttttttacgttagaatttatcgacgtagagtagggtagggagtgtggaagatatcgtttagattttgtcggtttagtgttgagtagtggggattgagtcgggcgggttagggagatagatatataggaagtggtgggtgagtattagcgtttattattagagcgtttttacgttgattgtttttattagaacgtttataattttttttcgtttttgattatgagtttatagaaaggtcgtggtttttttgatatatttgtggtttagttagtaattttgataattgtttgtttagtttaaaatgtatttttgggttaattttttaattttgtaatgtggaggtcgtatttagagttgattgtgggaagttgtgtttaattatgtttagaggaaattttttgagaatcgtataaaaatatagggagttttatagtgagatattggaataggaattaaaagaaattatagaatgtgtaaataaaaatttagttgtatttaagaaaatttagtttttttcgaggaagagaaagaggtggagttttttaaatatgaattgtttgtttttttgtttgtggttagtgagttttattttttttttttttaggtattgtgaagattttgttttttttgtcgtgcggttgtaagattattagataggataattttaagtcgtaaaatatattttttttgaaaagtaaggaataatgtgatgtatgttttaattgaataattgtttttgttttttgtttttgtaatatgtttttttttgtatagattttttttaattttataaaatgtttaaaaggtaatcggattttttgttcgagttttagtttttttggatgttaatttgattggggtcggtgtatttaaataataataataataataaattttttttaatttttcggtttttttgatttttaaattattttttaataatattattttatattagttagaatggttattattgaaaagttagaaattaatagatgttggtgagattgtggagtaaaggggatatttatatattgttggtgggtgtaaattagtttagttattgtggaaagtagtttggtttggagatattttagagaattataaatagagttattatttagtttagtaattttatcgttgggtatatagttaaaggaaaataaattattttattaaaaagatatatgtatttgtatgtttattgtagtaggatttataatagtgaagatatggaatttatttaggttttattagaggtggattggataaagataatgtgatatgtatatattatagaacgttatatagttttgaaaaattataagattatgttttttgtagtaatatggatgtagttagaggttattattttaagcgagttaatatagaaatagaaaattaaatattggttagatacggtggtttacgtttgttattttagtattttgggaggttgaggtaggtggattattttaggtcgggagttcgagattagtttgattaatatgtagaaattttgtttttattaaaaatttaaaattagtcgggtgtggtggtatatgtttgtagttttaattattcgggaggttgaggtaggagaattgtttgaatttggaaggtgaaggttgtagtgagtcgagatggtgttattgtattttagtttgggtaataagagtgaaattttattttaaaaaaaaaaaaaaaaaagaaaagaaaattaaatattatatgtttttatttataagtgagagcgttaaatattgggtaaggaggggagtaaggtttgaaaatttatttatttggtgattagattattaatgtaagttttagtattatgtaatatatttataaaaaatttgtatatgtatttgttgaatttaaaaagataaaaataggggttttgacgttggtttttttgtgtatagtatatatatgtttggataagttaattggttttattagaatggaatgataatattaatttttttaaagatagtgttataatgttttaataaaataaaagtgaaaagaaaagttttttatttaaagaatttaataagaaaagaaatatttttttttttttttttttttttttttttttttttttttttgagatagagttttgttttgttgtttaggttgtggtgtagtggtgtgattttagtttattgtaatttttgttttgtgggtttaagtaatttttttgttttagttatttgagtagttgggattatagatatttaatattacgtttagtttatttttgtatttttagtagagatcggtttttattacgttggttaggatggtttttaattttttattttaagtgaatttttttgtttcggttttttaaagtgttgggattataggtgtgagttattatatttagttaagaaatattttttttaagtaagtaattaattttttatttaataaaaaaaaattttatgtagaagttgttaagatttatagtaagaaaaaagaaatttatgtattttatatatatatatatatatatatatatattttttatatatatatatatatatatatttatatatatatgtatatatatatatatatatgtgtatatatattgtatagtatcgtatatgtatatatatatatgtatatatatatatatatgtatatgcgtatatatatatatatatgtatatatatatatatgtatatatgtatatatatgtatatatatatgtatgcgtgtatatatatatatatgtatatatatatatgtatgcgtgtatatatatatatatgtatatatatatatatatgcgtgtatatatatatgtatgcgtgtatatatatatatatatatatgtatatatatatatgtatatatatatgtatgtatatatgtatatatgtatatatatatatgtatatatatatgtatgtatatatatacgtatatgtgtatatatgtatatatatatatatatatatgtaaggtattatgtagtttttagtatttattggggttttggaatatattttggtggatatatgtgattattgtataagattagttgtatttttttgaggtaaataaatgtgttaatttttttttttttttttttaagacggaattttattttgttttttaagttggggtgtagtggtgtaattttagtttattgtaatttttattttttgggtttaagtaatttttttgttttagttttttaagtagttgggattataggcgtgtgttattatattcgattaatttttgtatttttagtagagatagggtttttttatgttggttaggttagtttcgaatttttgattttaagtgattagtttattttagttttttaaagtgttgggattataggcgtgagttattatatttagttcgttttttttttatttattgaagatttagtattcggtgttggcgtttttttttatatagttgttataattttgggtgttttttttatttttttttttacggagcgtttggatgttttttatggaggagatttatgtaggttggatttttagattttagttatttttttagttataatatagttatttttattaaagaaatataagaatattgttttttattattttgagtttttaattttgatataattttagatttgtaaaaatagtttaaagaatttttggttaggtgtagtggtttatatttgtaattttagtattttgggaggtcgaggtgggtggattgtttgagacgagtttgggggaaaaaaaaatgtaaaaattagttaggtgtggtgttgtgcgtttatagttttagttatttgggaggttgaggtgagagggttatttgagtttagggaggtagaagttgtagtgagttatgatcgtgttattgtattttagtttgggtgatagagtgttattttgtttataaaaaaaaaaaaaatttgtaatttttttatttagatttttttaaagttagtattttattatatttgttttattatttagttttttttttttttttttttttttcgaagaaagtgtgtttaatttgtatatgatgttttaaatttttaattattttaggttatattttttaaaattaaggatattttgttattaatgtttaaggttaagaaatagtattgatatgatattattgtttgatttatttattttatttaaattttattatttgttttattagtgatatatatttggtttaggatttaatttaagattatataatttatttaattgttatgttttttttatttggagatggaattttgttttgtagtttaggttggagtgtaatggtgtgattttagtttattgtaattttcgttttttgggtttaagtaatttttttgttttagttttttgagtagttgggattagaggtatttataattacgtttagttaatttttgtatttttagtagagatggggtttcgttaagttggttaggttggtttcgaatttttgaatttaattgatttatttgttttagttttttaaagtgttgggattagaggtatgagttattacgtttagttttttttaaaaaataaaattatagattttattttgattttattagtttttttattagtatttttttttcgttttaggagttttagtgattcgtttgttttagttttttatttgtttcggttttttaaggtattgggattataggtgtgagttatttggatttatttaatttagttttaagtttatattagtatttttgggattgttttttttttatagattttaagttatgtttgagatgatgaattttaagtcgtgatttaattatttaagtggtaagtgatatagaggatattattaatttttttttttttttttttgagatggatttttgttttgttatttatgttggagtgtagtggcgtaatttcggttcgttgtaagttttgttttcggggtttatgttatttttttgttttagttttttgagtggcgtaatttcgatttattgtaagttttgtttttcgagtttatgttatttttttgttttagttttttgagtagttaggattataggtgtttattattacgttcgggtaatttttttttttttttttttttttttaaagtagagatggggttttattatgttagttaggatggtttttattttttgatttcgtgattcgtttttttcggttttttaaagtgttgggattataggcgtgagttatcgtattcggtttttttttggtatttaaaaatataattttattgagatataatttatatgttatataattatttattaaaagtgtataatttaatggtttaaattttgtggtatttacggagttggtgtaatcgttaatatagtttaattttagaatgttgttattattgttttttagaattttatgtcgattagttgtttattattacgatttttttattttttcggttttaggtaattatttattttttgtttttaaatattagaaggtattttttaaaaattgtggtaaaatatatataatatatattttaatatttaagaagttttttaaggttaggtgtagtgggttatgtttgtaattttagtattttgggaggtcgaggtgtgcggattattaggttaggtgatttagattgttaggtttttgagtttaagttaagttattatatttttttgtggtttgtatgtatatatttagatggtcggtttttgttttaattgatgatattttattacgaaagaaatgaaaatggtttgtttttgttttaagtgatgatattattttatgaaatttttttttttggtttatttcggtttaaaagtttttttattgagtattttgtgaattttatttttgttcgttagagaataatttttttttgattgtaatttttttttatttatttaaattttataaaacggtcgtatttttatttttttttgttgattttttttttggatttagttcgtttgtatttaggtgaaataaatagttttgttgtttatataaattttgtttggtggtttttttatacggacgtgagtgaaatttggtgttataattcgaattaggggattttttttaggagattaattttttgtttttttgttttttgttttatgagaaagatttatttacgatttttcgtttttagattaattagtttaaggaatattttattaattttaaatttagtaagtagtttttttttatttttttttttaattttttttattattttttaattatttttttttttttattttttaatttttttttttttttaattttagtttttttttttttttggtagagataggagacgcgttttattcgtggatttaaaattttagcgtcggttatggattcgggaaggtagtttttttttggtgtttaattacgtagggatatttttttgattatttatttacgttttagaggtgtttgattatatggggatgtttgttttggttttttatttttagtggtaagtattgtttttttgggggggtaagaatttttaattttttttttgtgtttttattttttttttgtttttttgggggggtaagaattttttaatttttttttttttatttttagtggtaagtatcgtttttttagggggtaagaatttttcgattttttatttttgtgttttgacgttttatttttgtatttcgattttttatttttatatttcgattttttgtttttgtattttaattttttatttttgtgttttgatttttttttcg

SEQ ID NO: 53 - DNA, 5619 bp, Artificial Sequence
  chemically treated genomic DNA (Homo sapiens)
aacgtttgttatatgttaaattttataaaatgagtattcgatttttttaaaattttttaatttatttttattaattttattaataatgtttgttttattagtagtatttttttttttttggtttttgttaagttcgtgtttagagttaaggatagaattttatatgcgttattaatatgttgttatttgggataaaatttaataaaaagattaaggttagtgtttatttttgaggagttttattatatagaagtaaagagaggtgattgttattaatatttgggtgatttagagttagatgtatatttggggtagtttatattagttttttaaagtttattatgttttttttttttttttgtttggtttgttggtttgagatagggtttcgtattgttttatgggttggagtgtagtggtacgattacggtttagggtagtttcgaatttttggggttaagagatttttttatttaagttttcgagtagttgggaagttgggtttataggtatgcgtaattaggttaggttaattgttttatttttttatttttattagagatgaggttttgttatgttgttttagttggttttgaagttttggatttaagtaatttttttatttcgattttttaaattgttgggattgtaggtatgagttattattttcggttatagtattttttttttttttgggtgttaatttttttgtgttgtttattttttagtaaagagtaagtgttttttagattttggagtattattttgtattttttaagtgtgggttttatgtagtaatgttttttaaagagtttgaagaaattgagaaaagttatttttattgggtaattaaggttagtattaatgataaatgatatggatagtatattttttgttgttgttttttgagatagagttttatttttgttatttaggttggagtgtaatggtgttatttgttttattgtaatttttgtttattgggtttaagtaatttttttgcgttatttttttgagtttttggaattatagtgttttttattatgtttggttaatttgtgtatttttagtagagttggggttttattatgttggttaggttggttttgattttttgattttaggtgattcgttcgttttagttttttaaagtgttgggattataggcgtgagttattacgtttggttggatagtatatatttttgatacgatgtgatgagaagggagttttatttttgtgggttttttttcgaaaatttagagttttagtttaatgaagggatagtttataatataattaatattttttaaaatagtgaaggttatataaaatatttttaatttgaataaggtataaattttagttaataatgtgttaatattggtttgttggttataataaatgtattatattaatgtaaaatattaataatacggggaaatagggtattgggtatatgggaattttttgtgttatttttgtaatttttttgtaaatttgaaattgttttaaaaattgaagttttttttttgtttttttttttttgagaaaatagattttagggtttttattgtggttatttagatatttatttggtggttattaagtagtatttgttaagaaaaattataaaaagtatttttttttagatttggtttggaaattattttttcggaaatttttttattttattcgataaggaaaataaaagttgattattaatttgggaggggtgtgagtattcgttttttgaaaaatatgattttaattttaatgaatagaaagattacggatattagtgcggatcgtttgtagatttttaattgtatttttttaaagtaaaagatgttttttagattgtaattttagaagattggttttttttgttggttaattgtttttatttttagttaagatataaaattattattaatgattatttttgggtatttaagggaagaggatatttaaagttaaagtaaattttttatttaacgtggttagagaggatatcgatggaagcgaaaattttattatttgtttaatatagtgtttgtgggaaatattaggttattaagtttttttgataggttttttttacgagttagttagtataagttttttttatatattagatggaggtaagtttagagtgcgtttggaagttattaataggtttgttattgagtttttaataagtattggttgggttgggttgggttgttaaaattaggaagtttggttgggttttttgttttttttaagataatttgttaattagaaatatatagtgaggttgggcgtgtggtcgtttttttttttttttttttttttttttaacgaatgtttttgttaaatacgtgaagtgatagataagtattgggtttagttcggggaagtttttagtttttagtaattgagggtagttggaggtatagagtgataaagtttaggtagaaagagtttgtgtttttttgaatttatgttgtagttgttttttattttattttattttattatatttattaggattaagcgtagaagattatttaatatagtttagattaatttttttgtgagtggtaagtgatgggtttagtagtagaatttagggaggaaatgggtcggttttataatattaaaggttttaattttttttagtattagatagataattttttttttagttttaatataaagttttcgttaattattgtttataggaggtgatgggagttgcgtggttttattttagtgtttggagggaaggagcggttttttatttttgataattgggtttagttgtattttttttttttttttttttggtaatttttttttgttaattttatttttcgtttttttattttttttttttaaaggtatagaaattatgttttttgttttttgatagtttagttttaggtaagaggttagtagatagtattcgttttttagttttgggatttgtttgttattttttgttttgttgagagtgatttttagggagtagttatgagtaattagaaattggtgtttttaaggggtaagagggagtcgatcgttttttaagggtggtaggggttattgacgttttttttttttggtatttgggtaggggtattttttttttaggttttttaggaagggggacggttggagttaagaggatttttgtgtttagtttttaggtttgagtttttggcgggtttaggggttaggttaggggtagtttttatcgattttcgttcggatttaaatatttatagtcgaagaggatggagaagttaagttcgttttgggggttgtttttaggttcgtggtttggggcgttttcgtcgtcgggttggggttgtcgttcgggggcgtttatggcgcgtagggcgggaaggttgcggggtcgggggcgagggcgggcgcggttggttttgggatttttcgtagtggggttggcggaggcggttcgagcggcggggttttttttttcgtagggacgtacgtcgggttcggggacggcgcgtttggcgtagcgggttttggacgcgttcggggaagttgagcggcggcggcgacggcggcgcgagttttttgtttcggaggtatttgttgtagttcggggaggcggggggggggggggcgtggaggcggggatagggcggttaggtcggcgggggcggggtcgttattaggggatcggaggggaggggcgcgcggtttgggttggtcggtgtcgggaggaaggaggttgttcgcggatttgattatattgtttcgggttatcgttgggcgttggggcggtcgttgttttttattttttacgggtgagtgcgatacgcgttgcgcgaattagggtttagataagaaagttgtcgttattaggatttttgttttaagggatttattggttttatatttttttttgttttttttttttatggggtggaagggggtatttatttttttttattgtagattcgtgtttttaggcgttttcgtgtgtttacgggggcggtatgatttttatagtattttagatatttgtatggttttgaatttaattttttagcgtttaggaaggaatcggattgatagtattagtttttttcgttatagttatgttttttggttatttattacgtgttaggtgttgggtatttagtcggagttagatattgttgttttcggaagtttaggttttggtagtgggagaggtttgaaggagagaaataggataaaaagtatttgtttatggggttaggagagaatttattagggtatgggataaaggttggggtggttttagttttttgggtggttaaggaggatttttttgaggaggtgatatttgaagaaatttgattgatgaggcgattttggggaagtgtgttttggtagtgagaattaaaatatagagttagagttcgaaggggttgggtgtgttggagggagaacgaggagtatagttttgatggggcggttggtaagtgataaatacgtttggttgtttgtttaaagtatgatttttaggtttttttttggagtttttgattttataagtttgaatatagattcgtgaatgtgtatttttaattaagtatttaacgtgagtattaatgaataggtatatttggtaaatattgtataaggatttagtaattaaagaatattttttaataaaattttgttagggggttttattaatttagttgaagttggaaatagatttatagaggtagaaaagattaaaatagtggtttttaattttttttatatattagaattatttgggatatttttttaaattttcgtgttgggttgtaatttaaatttattgaagtagaatttttaatttttttttttttttttttttttttttttggagacggagtttcgttttgtcgtttaggttggagtgtagtggcgcgattttggtttattgtaagttttgttttttgggtttacgttatttttttgttttagtttttcgagtagttgggattataggcgttagttattatgtttggttatttttttgtatttttagtagagatggggttttattgtgttagttaggaaggttttgattttttgatttcgtgatttattcgtttcggtttttttaagtgttgggattataggtgtgagttattacgttcggtttgaaaatttttttaaattttagatgaatttaaggtgtagttagtgttgaggatgagaagattagacgggagaggttttaagattttcgtgagaattatagtttgattttaagtgattcgaatttttttttatgtgttaggaggaattgaggatacgtattttttaggggagttattttagttttattaaggggatttgtgttaagttatttattattttataaatatttattgagtatttgtttggtattgttataagatgttggggatgtaattattaataagttatagtttttttttttattatgtttatgttttgaaagtaaagtagtatagttatgaacggggtttttaaaattgtatttagattagtggtttttaatttagattatatattagaattatttggagagttgttaaaatttgtatttaacgatttgagtattattagatatcga

SEQ ID NO: 54 - DNA, 5619 bp, Artificial Sequence
  chemically treated genomic DNA (Homo sapiens)
tcgatgtttggtggtgtttaggtcgttgaatataaattttaatagttttttaggtgattttaatgtgtagtttgggttaagaattattggtttgagtgtaattttgaaaatttcgtttataattgtgttattttgtttttagggtataagtatgatgaagggagaggttgtggtttgttgatggttgtatttttaatattttgtggtagtgttaggtaggtgtttaataaatatttgtggaatgatggatggtttggtataaatttttttaatggagttgagatggtttttttgaagaatgcgtgtttttaattttttttggtatatggggaaggattcgaattatttgaggttaagttgtggtttttacgaggattttaagatttttttcgtttaatttttttatttttaatattggttgtattttagatttatttgaagtttaaaaaaatttttaggtcgggcgtggtggtttatatttgtaattttagtatttggggaggtcgaggcgggtggattacgaggttaggagattaagatttttttggttaatatagtgaaattttatttttattaaaaatataaaaaagtagttaggtatggtggttggcgtttgtagttttagttattcgggaggttgaggtaggagaatggcgtgaatttagaaggtagagtttgtaatgagttaagatcgcgttattgtattttagtttgggcgatagagcgagatttcgtttttaaaaaaaaaaaaaaaaaaaaaaaaaaaaattaggaattttgttttagtgggtttggattgtagtttagtacgggagtttaaaaaggtgttttaggtgattttaatatgtgggaagggttgaagattattgttttgattttttttatttttgtgagtttgtttttaattttagttaagttggtggagttttttggtagagttttattggagggtgttttttagttattgggtttttatgtagtgtttgttaaatgtatttgtttattaatgtttacgttgggtgtttaattaaaaatatatatttacgagtttgtatttagatttatggaattagaagttttagggaggggtttgggaattatgttttaaataagtagttaggcgtgtttgttatttgttaatcgttttattagaattgtatttttcgttttttttttagtatatttagttttttcgagttttggttttgtgttttggtttttattgttagaatatatttttttaagatcgttttattaattaggtttttttaaatgttatttttttagagaggttttttttgattatttaagggattaaagttattttaatttttattttatattttggtgagtttttttttggttttataagtagatgttttttgttttgttttttttttttaggttttttttattattagagtttgagttttcgagggtaatagtgtttggtttcggttgggtgtttagtatttggtacgtggtaggtggttaggaggtatagttgtaacgggggggattagtgttgttagttcgatttttttttaggcgttggggagttgagtttagggttatgtaggtgtttgaagtattgtgaaaattatgtcgttttcgtgggtatacggagacgtttggagatacgggtttgtaatagaagggggtggatatttttttttattttatggagaagaaaagtaggaaaaagtgtggggttagtgggttttttagggtaaaagttttagtggcggtagtttttttgtttagattttggttcgcgtagcgcgtgtcgtatttattcgtggagggtgggagatagcggtcgttttagcgtttagcggtggttcgggatagtgtggttaggttcgcggatagttttttttttttcggtatcggttagtttaggtcgcgcgtttttttttttcggttttttggtggcggtttcgttttcgtcggtttggtcgttttgttttcgtttttacgtttttttttttttcgttttttcgggttgtaataggtgttttcggagtaggaagttcgcgtcgtcgtcgtcgtcgtcgtttagttttttcgggcgcgtttaggattcgttgcgttaggcgcgtcgttttcggattcggcgtgcgtttttacgaggaaagggatttcgtcgttcgagtcgttttcgttagttttattgcgaggggttttagagttagtcgcgttcgttttcgttttcggtttcgtagttttttcgttttgcgcgttatgaacgttttcgagcggtagttttaattcgacggcggggacgttttaggttacgagtttgggggtagtttttaagacgagtttgatttttttatttttttcgattatgagtatttgaattcgaacgaaggtcggtggaggttatttttggtttggtttttgagttcgttaggggtttaggtttggggattgggtataggagtttttttggttttagtcgtttttttttttaaggggtttggagggagggtgtttttatttaggtgttagggaggggaggcgttagtggtttttgttatttttagggggcggtcggtttttttttgttttttaggggtattagtttttggttgtttatgattgttttttgagggttatttttagtaaaataaaaggtggtaggtaggttttaaggttggggggcgggtgttgtttgttggttttttgtttgggattgggttgttaaagggtaagggatatgatttttgtgtttttggagggaggaggtgaggaagcgaagaatggagttagtagggaggagttgttaaaaaaagaaggaaggggggtgtagttgaatttagttattaagggtaggaggtcgttttttttttttaggtattgaagtgaggttacgtagtttttattattttttgtgagtagtggttgacggggattttgtgttgaaattgaggaagaggttgtttgtttgatgttggagagggttaaaatttttggtattataaggtcggtttattttttttttgggttttgttgttgaatttattatttattatttataagaggattggtttgagttatattaagtgattttttacgtttagttttaatggatgtggtgggatggggtagggtgaggggtagttgtagtatggatttagaaggatataggttttttttgtttgaattttgttattttgtgtttttaattgtttttagttgttgggggttggggattttttcgggttgggtttaatgtttatttgttattttacgtgtttaataggagtattcgttagagggaggaggaggaggagggggaagcggttatacgtttaattttattgtgtatttttggttagtaggttgttttggaaaaaataaaaaatttaattaggttttttgattttgatagtttagtttagtttagttaatgtttgttgaaggtttagtggtaggtttgttagtagtttttagacgtattttgggtttgtttttatttagtgtgtaggaagggtttgtgttgattggttcgtggaggaagtttgttaaggaggtttggtggtttgatgttttttataaatattgtgttaggtagataatgaagttttcgtttttatcggtgttttttttggttacgttaggtgaggggtttgttttagttttgggtattttttttttttggatatttagagatggttattagtaataattttgtgttttggttggagatggaaataattagttaatagaagagattagttttttagagttgtaatttggaggatattttttgttttgaaaagatataattaagaatttgtaaacgattcgtattaatattcgtggtttttttgtttattaagattaaagttatgttttttagggaacgaatatttatattttttttagattggtaattagtttttattttttttgtcgggtggggtggggggattttcggggaaatagtttttaagttaaatttgaagggaggtattttttatggttttttttggtaagtgttgtttggtggttattagatgggtatttaaatgattataatgaaagttttggaatttgtttttttaaaaaaaaaaaaataaaaaaaaaattttagtttttggaatagttttagatttatagaaaagttgtaaagatagtatagagagtttttatatatttaatattttgttttttcgtgttattaatgttttatattagtatggtgtatttattgtaattaataaattaatattgatatattattaattgaggtttatgttttatttagattgggaatgttttatgtgatttttattgttttgaggagtgttggttgtattgtagattgtttttttattagattagggttttaggttttcgggaggaagtttataaagataaagttttttttttattatatcgtattaagagtatgtattatttagttaggcgtggtggtttacgtttgtaattttaatattttgggaggttgaggcgggcggattatttgaggttaggaggttaagattagtttggttaatatggtgaaattttaattttattaaaaatatataaattagttaggtatggtggaaggtattgtaattttagaaatttaggaggatgacgtaggagaattgtttgaatttagtaggtagaagttgtagtgaggtaggtggtattattgtattttagtttgggtgataagagtgagattttgttttaaaaaataataataaaaagtatattatttatgttatttattattaatgttaattttgattatttagtagaggtagttttttttagtttttttaaattttttggaaggtattattatatgaagtttatatttaaggagtatagagtaatattttagaatttggaaagtatttattttttgttgagaagtaggtagtatagaagagttagtatttagaaagagaagggatgttgtggtcgggagtggtggtttatgtttgtaattttaataatttgggaagtcgaggtgggaagattgtttgagtttagggttttaagattagttggggtaatatagtaagattttatttttaataaaaataaaaaaataaaataattagtttagtttagttgcgtatgtttgtagatttagttttttagttattcggaggtttaggtaggagaattttttaattttaggagttcgaggttgttttgagtcgtgatcgtgttattgtattttagtttatgggatagtgcgaaattttgttttaaattaataaattagataaaaaaagagaagggatatggtaagttttaagaggttaatgtgaattgttttagatgtgtatttggttttgggttatttagatgttaatagtagttatttttttttgtttttgtatggtgggattttttaggggtgaatattagttttaatttttttattaggttttgttttagatggtaatatattggtgacgtatgtaaagttttatttttaattttgggtacgagtttggtaaaaattaaggaaggaaaggtattgttaatggggtagatattgttgatagaattggtgaaggtaaattagggaattttggggaggtcggatgtttattttatggagtttagtatgtagtagacgtt

SEQ ID NO: 55 - DNA, 11143 bp, Artificial Sequence
  chemically treated genomic DNA (Homo sapiens)
cgtaagaattgtagtaaatagaattgtaggaattggaataatatacgaaggattagtattgtttaaaaatttttttttatttttttaaattttttgtttaagagatttttttgttttttttgtttattatgtttttttttgttaattagtttgatttttattaaatgttttgttagtaatatgatttttattaaatgtattattaaaatggattacgtaatgatattatgaatttaaatatttttaagatttaaaaatgtgtaggtagttttattgaataaataatattttataaattattttttatttttgtgtaaaggatagtgtatttgttgaagaaaattagtaatatttgtttgattttcgtttttattaaaaaaaatgggttaatttatattaatttaaaaatattttattgatgaaaaatgtgaattatatgtaagtagttttttttttttttttttcgttagaaaaaaatataatagtttgtatttgttggtaaaattggtttattttgtaaagatggtattgtgttttattttttttggtttattaaagagttaaatatttttgaaattatatttattttatttttatattttttttttttagtttttgtgtgtttattgaaaatattgttgggttttttaataatttttttagaattgttttttaatcgtgtttatggagaggtggttatattttgtttttttagtggtttagatacgtagtttgtttagaaagttatagtcgttgtggaggaggtaagaggttagttttttcgttggttttggtgagggtaaaatttttaggtaggaggagtattgattggtaaagggaagaggaaagggttcgttttggattttataaattcgttttttggagtaaatagtttgtaggtagaggggtttattagagtttgtttagttttcgggagggttaattttagttagtaagaagatttgaggcgtaggatttttgcgtaggaggttgtaggaatgttttcgttagtcgtaaggtttttgttggtttgtagagttttcgtgattttcgttaagatgcgaatagtaaggttttcgtatggatcgtagtttttgttcgaaatttgaaaatattaatttgggatttcgtagttttggttttcgggttcgtttcggaggcgtatttttaatttttacggaacgaatttcgcggttaaaatgtatttttttaaggtagtaaaagtgatttttgtatttaataatttttgggttttttttttttttgattattatttttcgtagggtgcgttgaaatttttttatcgttatcgttttttataaatgaaatgatttatttattcgttgtttgtagggaatgaaaggagttgattttgattttaagatgtattttaaagaaagaaaacgtaattgtagttcggatttcgcggaggaaggttaattgattttattacgtgtattttcgagttatttgggtttagttagttgtgttaattatgggttttaattttattgtaattcggtattttttggtttgtttttattatagtggttttaaaaagaaatatatataggtatattttagaatgaattttcgggaaggtaaaggtagattttttcggtgtttgagttgatgttttgagagcgcgttgagagtttcgggtatgttttggtatttttggaaataaattgtagttaagagtacggttttttcggttttttttttgtttttttgtgcgtcgttcggtcgcgggatttttggaatatgttgtgtatcgttcgagtggttgcggattttatttcgacgttttggatagtcggggttaggaggagacgagtaggtagtttttcgtttttatttagttagttgcgattttcgcggcgtggatttttggttagtagtgaggaggataaggttgtagattttttttgttgcgggttttgggttcggttttgggcggtattttgttttttaaagtgtggaggtgggtagaagagtgtttatttttagtgtagatatttgaggtatgggggtttttttgggggttttagcgtgagttgtttttgtagattagggaaatggagagaataataatggggatatggtggaatttagatttttttttgttaattaataatatgatttcgtttagtttaagtgttttttgtgtttttatttaatgttttttgtaaaatgggaattagaataatatttttttggtatggttgttgtgtttgacgtgagtttttaataaatggtaggatgaattggagaagaatgggtttattattttttatatttttttttgtagagtttttttgttgtttttagttttttcgttttgacgtaaggatagtttataattagtgtttttgagtagtttttgggggtcgtaagagaattcgttcggtagggtatagaagatgggttttcggtgaatcgtgaaaagatatgatcgggttttttttggagtatggtggagaatgatgcggagttttggggttaatggagagttgagggtgtagagggatttgaaagggggaattaaaaatatcgggttttgaaattttgtggatttttaaaggcggtttttaattttgttaaaaattatagtgggtgcgcgatttaatttggtttttataggtggcgttgtgataaggtgcggtggtcgggagaggcggttgggggattcgaagattgcgggaaattttttgcgatttcgacgttaattcgttgtttttagttttcgttttttgttttcgagggattagttaggattgtgtaatattagttttcgttttcggagtcggtacgggggttggtgggtggcgggatgaattcggggaaggcgataggttggaaacgtagtttttcgattttgtagcgtattaattttttatcgtttcgttcgttgtttaggtgcgaggattcgttagacgttataggattgggggcgattcgtaagggtattatgttatttagaggaaacgcgtagtgagtgagttttgggttattgaaaatgggagaacgttcgagtcggttaagatgatttcggtttgcgagttgatttagatttttcggaagttagaaattgggtttagagtgggttggttttttcgttagtagttcgggtttagtcgaagtttggggtttagagggtagacgttcggttttgattagagtatagcgggttgggtttggtagtttgtaggtaatttggattttgtaataaagttgtatttaatataatttagattatagtgggagttttcgaagggttttatgtgagtttcgaaattagagtttagaggcgcggtttggttttcgtttattttttttagatagtatttaggttaataaggtttttgaaaggaggtagttttaaagtttttaggtcgatatttgagggtagggttttaaatagttgtgtttgaagaatcggtaattttgttttttttatacgtagttgtattttttttgagcgttgtagttgatggttgtatagtgattacggattgcgttttttttacgaagttgcgtaatttttgttaatgttgtaattttggtaagacgaaatttttttttttttggttagattagtttagtttttttttagggatttttttgtttttttttatttttttttatttttaggtcgtttttttttttttttgttgggattcgatttttgttcgtttttgtaatttcgtagttcggagttttgtttcgtgtattaaaatatgtttttttttatttgtagatttaataaataaacgtaattatattatatggagttttatattgtttttttgaaagtaatttcgttgttgaaaattgaaaaatgggtgtaatttgtttttagaaagtaatgttagggttacggtaatttttcgggtcgttatttatttttattttaaagtttttaggaaagatttgtttatatgttcggaaaatttttaaatgcgcgaatattagtaatttcgttcgtttttaacgcgtggggtaagggggggtggggaataattattgagtgacgttaatatggggaaattgaaaagaaatgtcgattgtttttattgtaatagaaggagtgagtaaatagaaaaattaatttcgggtgatcggaaataggtaggcggagaattaaaagcgggttttagatagtaataggttttttttttgttttcgtaaggagaaagcgggcgacgagcgttcgtagttcgtggggttgattttatttttcgtagggtttcggtcgtgtcgttgtcggatcgtagaacgtcgggacgtattttcgagttcgggttcgatttaattcgttgttattttagttatttagtggagtcgcggagagatttttgaatcgtgaggttttttgatgagaaggtggagaggttgtcgggttatttttcgagtatttttcggtcgagttttgttttttttcgtgcgtttgcggtttttttttgggttagcgcgttcgtagtttttttaagtttaggtcgtaggttagtgtgcgggcgttttttgttttttttttttattagaggatttttgagggttgtttttatttttaattttcgcgattgttttttttagtcgttattttttttcgtagcgtagattttgtaggggttagcggtttagggcggattttttttcgttttgggcgcggggcgagtttttggttgttatttgtcgttgtagttttagggaaatttagttggtcgtttattttgtaagacggggatatagtagagggtcgagttttggagaagttgggtttgtttttttttttgtatcgcgcgtaatgttttaattgattttgaagggttttgtttttattgtatttgtttttagacggttagaagttaatgtattatgaaaattttagtttcggatttcggattttggttgttttataatttttgtaattttttcgagtggataagaggcgggtatcgtcgtttgggtttcgtttggggggggggggttttgtttttagtagggggtaagttggaggaattagttttttaatattttttgttagttttgtttgttataattgtaattcggaatagaataatttttttttcgtgtatacgtatttttaattttcgttttatttttttatttatagttattattgatttgtagattcggaggagtaggttttcgggggtcggtttaggttggggatatagggaggggttttcgcgtttcgtataatttgtagtgtttgggtttgatttcggtagttttcgggtatagtttgtcgggttagattttcgttgttttttcgcgttttttcgcgggtcgttttagcgtcgggaagggggcgtcgtaggtgattgttcgcggtattgggacggttgatagatttatggagattttatagtatttggttggggttcgcgagggtagggcggagttcggtcgattcgatgttggggtttaaagtttttttagttatacgtttgggtcgagtcgtttttagagttttcggtttttgttttttttgggcgggtgtatataaggattcggttagcgtcgagtgtattggttttttttatttagtgtagtttttttttttatattttcggttcggtttttagttttttattgagtaaatatttatttagagagcgagtcgtttttcggaggaggtttcgacgcggttagggaaaggttttttggtttttttttggtttgagttagttgtaggttttattggtgttttggttttggttttaaatttttttttttagtcgaaattttttcgatttttttgagattttttgagtttagagtgagtagtgtaattaggcggtagattttagttgatttttgtttttgttttaggttttgtatttttatatttatcgggattgattagattttagtgttttttttttttttttttttattttttttttttgttttagattcgtcgtttttcggtcggttttagcgggtcgttgattatttcgttttagtattcggttcgcgtttcgggaaggttttagtattatttttttttgttgggatttcgttgattttgtttgtagtttcggttttttttgtttttagagcggggttttcggtttgtcgcggatatttagtggtttaaaatatttaaaattgattttttttgcgtttttgagaatgttaagagtatttagtatttgtaatcgtcggtatgagtggggtttgcggggagtcgttagagttgcggataggttttttgtttattgagttgttatttttggtacgtttaggggattcgtagtagttgaggttatatggttatagttaagtttagtaggtggaaagggagagatggtattgaatttatgtgagaattgggaagatgtgtggtagttgaaggagttggtaggaataagagggagttgtatgttatttttatataattagagttttaaattatattagtttttgaattagtttaggttggtgttgtagaattgttaaagttttcgtagagtttttagatttttcgcgggatatgaggttttgtttgttcgtatgcgaatatttttgtattcgtttagtagttttgtagattgtaaattttttttgggtgtacggaagtagagtagatttggcgtagaggtcgatatttattgtttgtttgtgaggggggaggaggatttttttttggttaagttgtcgggtatgtttattttttttcgtaagtttaaggtagagttataagtttttttacgatgcggtaaagttttaattaatttatttattagttttaagaaggagttgttgtttttaaaatttttagattttcgaaggttttttttgtgtaaaaatgttaggcggtgttatacgatgttatttaataggtattggaggttagattaggttgaaattgttattaagttaaattttaagaagattttaaatatttgaaattaattaataaaaagggataagtttaagtatgtttagttgtgggattttttttaagatttcgattttaaagagtggtgttttagtttatttttattttttatattttttattttgttaggtaattttgaatttagagtgtattttaattatagaagtgggaatttggagatttgtttttttgtagaagtatggttgattatagtttttttttgggtttttgtaatttattgatttgagatttgggattagttagtttttttgggtgtagatcgtagttatatatatttttggggattgttggggaagtagtttgaattttgtgtgtataaggagttttttggattgttaagtagtagtaatagagtttacgattttaagtagtataaatttttaaatttacgaaaatatttttttttttgtttattattttgatttatattttttataattttaattgtaaatattaataattttggttgtaaaaaagtatacggtatattttagattagatttatagtgaataaaagtgaaaatttagaagtaggtagaacgatagggtttttggagtttaatggaagacgagggaattatatttatgtgtagcgtcggtgtttattgttttgggattaagttttttttatatttaaataaaattttttcgagagggttcgttggtttggagaatttttataaacgttgttatcgagggttaggggtttaggatagtggttgaatgtggtagagttttgggtttcgtagtgagtgttttacgtattggtaattggtcgatttggggttgtgcgttagcgttagtcgtttgtggtttagtttttcgtatacggcgtggttcgtgtttcgagtttgtgtggttagtggttggtcggtttatttggattggggggtcgtcgtaggaagttggcggtaggaggaatttttttggttttaatagtggtttttatttgtggttcgggtttttcgtaattttttggtttttttggtcggtttatttttttatatttgcgttttcgttatttggtatggattgaagtgaggtagaatcggtaggtgatatagatttttttttgatagtttttagaggttcgtatgatagattttgttaagataatttttttatttttgtgtacggtggcgttcgttttttatttatagttttaattttaattttgagatgtttatcgtttttcggaggaggttttttcgggtttttttttttttcgagttatttatatttagattaaacgtttttatttgtttatttagtattttattagtttgattttgttgtttttttgtgtcgtttttgggaagatgttaaatatttatttttattgtatttagttatttaggtggggagttagtttgaaagagatagcggaaggagttttttggattgcgttgtcgtttatcgattcgtattaattattatgtagtttgttttcggattcgttttttttagggcgtgtttttagtgagtgatagacggagtcgttttgttttgtttagtttagtttacgttgttgtttagattgaaatgtagaatttaagttttttttatcggggtatagatttttttttattttttttttttgttttttcgttttttttttttgggaagaagcggaggcgtcggcggtcggtcgggatagtaataggtcgggttattgaggcggtgcggaaagtttttgtttgggagtgcggaattggggtcgggttggtgtattgttcggagtaatgggtgagtggcggcgggggattttgttagagtcgggaagggagggagggagcgagcgggtaagggagggagggagggagggagcgcgagggcgcgcgttattaggcgtttatattttttattgattttgttcgtgtttttataagttgtaggaatacgttaagggttagcggcgtatagtagtttaatgtgaacgttggttattgggtggttgttgatgttattttttgattttaagagaagggagttgtggtattagcgagttttttagttcgagtagtaaattaagttttgttttatacgcgcgtatatatgtaaataaaataggaaaagaaaagaaaagaaaataaataataataaataaaatattttttagttttttttagattttgtttaattggtcgggtttttagaaggaacgttggggatgggatgggtggagagagggagcggtttaaggattttagtgaggagtaggcgagaaggagtacgtttaggcgttaagatcgatttttttttttgtttcgggagatttttgaacgttcggagaggttcggtattttattattttatttggtcgtaggggttttcggtacggtaggaatgagggagggggttcgattggatagtgacggtttggggtcgttcggttatgtttagggattatatggtttggggatagttttagtagttagtaggggacgggtgcgttcgtttagttttcggatgcgtagggaggtttagtggtaggtagttgttttaagtagcgggtgcgcgtttttgcgcgttgtgtgtttattttgtagagttagttttcggggaggtgaattagttgggaggagtgttcgtgaacgggaggtcgttgtttaacgttattcggtttcgtatcgtggaattggtttaattgggtattcgatcgtgtgatattagtcgttagttacgggtttcgtacggttgcgttagtaagattttggcgcgatataacgagacgggttcgattttgttaggagttatcgggggtagtaagtttcgggttattatttttatcgtggtgaaatatattcggatttataagtagagagatttcggtattttcgtttgggagattcgggatcgtttgttggcggacggcgtgtgcgataagtataatgtgtttttcgtgagttttattagtcgtattttgcgtaataagatcggtaatttggtttagtagggttattacgatttatataagtagtattagtcgacgtcgtagttagcgttgttttataattatatttattcgtattttagttttattacggcggcggtcgttaaggtgtttacgttattcggggtgtttgttattttcggttcggtggttatgtcgcgtatttggtttttttcgtatttcgttatcgatattttgggtattcgttttattatcgattaaggtaggggtttagaggttgggcgtgtggatgtgtagcgtttgttttcgtattttcgcggaggttttagtatttgtagttttagggatattgttttttttattatttgaggtttttttttttggaaacgtaaggagtttttttagggggtgttttgattttattaatttgaaatttatgtttttggtttttttgttatatatagttttttgttttattttaaattattagatttataatatttttttatttttaatatatggttcgtattttttattttttttcgtttttcgcgtcgaggtagttttagttcggtttgtttatttggagagtgcggtcggggttggatttggggcgtagttcgggaggttcgagtttgtttggggttgtcggttgtagatttcgttgtgggtagagtagtttgtttggggattattacggtcgggagaagtttggtcgggaggagtttagtacgttttggaaattgaagtatttttcgattttggtaattaggttaaatttgtttaggtaggaagtttaaatgttatttaattggtttcgtttttatgttttattttatttttttcggaaatggaggtttcgaagttattattagtaatttgtatgtaatttatttttagacgaagttatatttatattttttttttttttttttttttttttatttattttttaatttaatagattttattgtatatattttaggaagggaagtggtattagttattgtagtgatggagataaaatgtaggtaattttatgttgtttttttattgttttttttagttttttttgagtttgttatttttttttggggttttcgggttttcgggttttcgagaatgtaagtggatatttatttagtttttgtatgttttaagtagtgttattttattgtttttttttttttttatttttgattttgtttagttttaagcgttttttttgttttgttagaaggatttttcgagtttttttgtttagttcggttttcgta

SEQ ID NO: 56 - DNA, 11143 bp, Artificial Sequence
  chemically treated genomic DNA (Homo sapiens)
tgcggaagtcggattgggtaggagggttcggggaatttttttgataaggtagaaaggacgtttaggattaggtaaggttaggggtgagaaaggaaagaaatagtggggtggtattgtttaaaatatgtaggaattagatagatatttatttgtattttcggggattcggggattcggggattttaaaggaaagtggtaggtttagggaaaattgaaaagaatagtaaaaggatagtatggaattgtttgtattttatttttattattgtagtggttgatgttatttttttttttaagatatatatagtgaagtttgttaagttagaaagtgaatggagagagaaagagagagagagagaatgtgaatatgatttcgtttgggaatgagttatatgtaagttattagtagtaatttcgggatttttattttcgaggaaaatgaagtgaagtataagaacgaaattaattaggtgatatttgaattttttgtttgagtaaatttggtttgattattagaatcggagaatattttaatttttaaggcgtgttggatttttttcggttagatttttttcggtcgtagtgatttttaagtaagttgttttgtttatagcggagtttgtagtcggtagttttaagtaggttcgggtttttcgggttgcgttttaagtttagtttcggtcgtattttttaagtgagtaagtcgggttgaggttgtttcggcgcgagaggcgggggagggtggaaaatgcgaattatgtgttggggatggggggatgttatgggtttggtagtttgagatgaggtagaagattgtgtgtggtaaggaaattaggggtatgagttttaagttaatgagattagaatattttttaggaagattttttacgtttttaaaggaaaaagttttaggtggtgggaaagatagtgtttttgaggttgtagatattgggattttcgcgagagtgcgggggtagacgttgtatatttatacgtttagtttttgagtttttattttggtcggtgatggagcggatgtttaggatgtcggtgacggagtgcgaggagggttaggtgcgcggtatggttatcgaatcggggatggtaggtatttcgggtggcgtgggtattttggcggtcgtcgtcgtgatagggttggggtacgagtagatgtggttgtagggtagcgttggttgcggcgtcggttggtgttgtttgtatgagtcgtaatgattttgttgggttaagttgtcgattttgttgcgtagaatgcggttgatggagtttacggagggtatattgtatttgtcgtatacgtcgttcgttagtaggcggtttcggattttttaggcgaagatgtcggggtttttttgtttgtaggttcggatgtgttttattacggtgggggtagtgattcggggtttgttgttttcgatggtttttggtaagatcgagttcgtttcgttgtatcgcgttaggattttgttgacgtagtcgtgcgagattcgtagttggcggttgatgttatacggtcggatgtttagttgggttagttttacgatgcgaagtcggatggcgttgggtagcggtttttcgtttacgaatattttttttagttggtttattttttcgaaggttggttttgtaaaatgaatatatagcgcgtagggacgcgtattcgttgtttgggatagttgtttgttattgggtttttttacgtattcggggattgggcgaacgtattcgttttttattaattattggggttgtttttaaattatatggtttttgaatatagtcgaacggttttaaatcgttattgtttaatcggatttttttttttatttttgtcgtgtcggaggtttttacggttaagtaaagtggtgagatgtcgggttttttcgagcgtttaaaagtttttcgaagtagggggagaaatcggttttgacgtttgaacgtgttttttttcgtttgttttttattaaagtttttgagtcgttttttttttttatttattttatttttagcgttttttttggagattcggttagttaaataaagtttaggggaagttagagggtgttttatttgttgttgtttgttttttttttttttttttttttgttttgtttgtatgtgtgcgcgcgtgtgaaataaaatttggtttgttattcgggttgaggggttcgttgatgttatagttttttttttttaaaattagaaaatggtattaatagttatttagtagttagcgtttatattgaattgttgtgcgtcgttgatttttagcgtgtttttataatttgtaggaatacgagtaaagttaatagagaatgtgagcgtttagtggcgcgcgttttcgcgtttttttttttttttttttttttgttcgttcgtttttttttttttttttcggttttgatagagtttttcgtcgttatttatttattgtttcgagtagtatattaattcggttttagtttcgtatttttagatagaaatttttcgtatcgttttagtggttcggtttgttgttatttcggtcgatcgtcggcgttttcgtttttttttaggaggaggaggcgagagggtaaaaggaagaagtaaaaggaagtttgtgtttcgatgaaagaggtttgagttttgtattttaatttaagtagtaacgtgggttgggttgagtagggtagggcggtttcgtttattatttattggggatacgttttaaaaggggcgggttcgagggtaagttgtatggtgattggtgcgggtcggtgagcgatagcgtagtttaggaaatttttttcgttgttttttttaggttagttttttatttgggtgattaaatataatgaaaatgggtgtttgatatttttttagaagcggtataaaaagatagtaaaattaggttggtaaaatgttgaataaataaatgaaagcgtttggtttgaatgtgaatgattcgaagggagaaggggttcgaggagatttttttcggggaacgatggatattttagaattgaagttaaggttataggtgggaggcgggcgttatcgtgtataggggtgagggagttgttttagtaaaatttgttatgcgggtttttggggattgttaggagaggatttgtgttatttgtcgattttattttattttagtttatgttaggtggcgagagcgtaggtgtgagaagataggtcggttaaagaaattaggaggttgcggggagttcgagttataggtgggggttattgttaaggttagggaggttttttttatcgttagttttttgcggcgattttttagtttaggtggatcggttaattattagttatataggttcgaggtacgggttacgtcgtgtgcggggaattgaattataggcggttaacgttagcgtatagttttaagtcgattaattgttagtgcgtggggtatttattacggagtttaaggttttgttatatttagttattgttttgggtttttggttttcggtggtagcgtttgtgagggttttttaaattagcgagttttttcgaaagagttttgtttaaatatgaaagagatttagttttaagatagtggatatcgacgttgtatatggatgtaattttttcgttttttattaagttttagaggttttgtcgttttgtttatttttgaatttttatttttatttattgtaagtttaatttaaagtgtatcgtatgtttttttgtagttaaagttattaatatttgtagttagggttgtggagaatgtgaattaaaataataaataagaagagaaatattttcgtgaatttgggagtttgtattgtttggggtcgtgaattttgttattgttatttgataatttagaaggttttttgtgtatataggatttaggttgtttttttaatagtttttagggatgtgtgtggttgcggtttatatttagagaagttgattggttttagattttaggttagtaagttgtaagaatttaggaaaaaattatgattagttatgtttttgtaaaggaatagatttttagatttttatttttatggttaggatgtattttaaatttaaaattatttaatagaatggaggatgtgaaaggtaaagatgaattaaaatattattttttagaatcggaattttgggggaaattttataattagatatatttgaatttgtttttttttgttggttggttttaaatgtttaaaatttttttgaagtttgatttgatagtaattttagtttggtttgatttttaatatttgttgggtgatatcgtgtggtatcgtttggtatttttatataaggagagttttcggaaatttaaagattttagaagtagtagtttttttttaaggttggtagataaattagttgagattttgtcgtatcgtaggggagtttatgattttgttttaggtttgcgggagggaatgaatatgttcggtaatttgattaggaaggaatttttttttttttttatagataggtagtgagtatcgatttttgcgttaaatttgttttattttcgtgtatttagggaaaatttgtagtttgtagggttgttaggcgggtataaggatgttcgtatacgaataggtaagattttatgtttcgcggggggtttggggattttgcgagagttttagtagttttgtagtattagtttagattggtttagaaattgatatggtttagagttttggttatatggaggtaatatataatttttttttgtttttattaatttttttagttgttatatatttttttagtttttatataggtttaatgttatttttttttttttatttgttgaatttggttgtgattatgtggttttagttgttgcggattttttgggcgtgttaggggtagtaatttagtgggtagggggtttgttcgtagttttggcggtttttcgtaggttttatttatgtcggcggttgtaggtattgggtgtttttggtatttttaagagcgtaggaagagttaattttaggtgttttgggttattaagtattcgcggtaagtcgaagatttcgttttgggagtaagagaagtcgaagttgtagatagggttagcgggattttagtagaagagggtgatgttgaagttttttcggggcgcggatcgagtgttagggcgaggtagttagcgattcgttgagatcgatcgagagacgacggatttgaggtagagaaagaggatgaaggaaggaaaagagagaatattaaggtttggttagtttcgatgaatgtaaggatgtaggatttagaataagaataagggttagttggagtttgtcgtttggttatattgtttattttggatttagaagattttaaagagatcggaagaatttcgattaaaaggagaaatttaagattaaaattaaaatattagtaaggtttgtagttggtttaggttagggagaagttaaaaagtttttttttagtcgcgtcgaggtttttttcgaggggcgattcgttttttggataaatatttatttagtgggagattggaagtcgggtcgagagtgtgaaggagggggttatattgggtgggaggaattagtatattcggcgttggtcggatttttgtgtatattcgtttaaggggagtaggggtcggggattttgggggcgattcggtttaggcgtgtggttggggaagttttagattttagtatcggatcgatcggatttcgttttgttttcgcggattttagttagatgttgtgaagtttttataaatttgttagtcgttttagtgtcgcgggtagttatttgcggcgtttttttttcggcgttagagcggttcgcggagagacgcggagaagtaacgggaatttagttcggtagattgtattcgagggttgtcgaagttagatttaagtattataggttgtgcggaacgcgaggatttttttttgtatttttaatttggatcgattttcggaagtttgttttttcgggtttataggttagtgatgattgtggatgggaggatagggcgagagttgggggtgcgtatgtacgggagagaggttgttttatttcgagttgtagttatgataagtagagttagtagaaaatattaaggagttgatttttttaatttgttttttgttggggataggattttttttttttaagcgaggtttaggcgacggtgttcgttttttgtttattcggaggagttgtagggattgtaagatagttagagttcgaggttcgggattgggatttttatagtgtattgatttttagtcgtttgggggtaaatgtagtaaaggtaagattttttagggttagttggggtattgcgcgcggtgtagagagaaaaataagtttagtttttttagaattcggttttttgttatgttttcgttttgtagggtaagcggttagttgagtttttttgaaattgtagcggtaagtgatagttagaagttcgtttcgcgtttagggcgagggagggttcgttttggatcgttggtttttgtaggatttgcgttgcgggaggggatggcggttaaaaggagtagtcgcggggattggggatggagatagtttttaggggttttttggtgggagaggaggataggaggcgttcgtatattgatttgcggtttggatttggagggattgcggacgcgttagtttaaggagaagtcgtaagcgtacggagaggagtagagttcggtcggaagatgttcggagaatagttcggtagtttttttatttttttattaaggagttttacggtttaagagttttttcgcggttttattaggtagttagaatggtagcgggttgggtcgggttcgagttcggaaatgcgtttcggcgttttgcggttcgatagcgatacgatcggagttttgcgggaggtgggattagttttacgggttgcgagcgttcgtcgttcgttttttttttgcgagagtaggggaggggtttgttgttgtttgaaattcgtttttaatttttcgtttgtttgttttcgattattcggggttggtttttttgtttgtttattttttttattataataaaaataatcgatatttttttttagtttttttatattagcgttatttagtaattgttttttatttttttttattttacgcgttgaaggcgagcgggattgttggtattcgcgtatttggaagtttttcgagtatataagtaaattttttttaaagattttaaagtaaaaataaataacggttcgagaaattgtcgtgattttaatattattttttgaaagtaaattatatttattttttagtttttaatagcggaattgtttttagaaggatagtgtggagttttatgtgatatggttacgtttgtttattaaatttgtaaatgaaagagaatatgttttaatgtacggggtaaaatttcgggttgcgggattgtaagagcgaataaggatcggattttaatagaggaaggggggagcggtttaggggtagggaggggtagggaggggtaggaaggtttttgaggggaggttgggttgatttagttagagggagggggatttcgttttgttagggttgtagtattagtagaagttgcgtagtttcgtgaggaggacgtagttcgtggttattatatagttattagttgtagcgtttaggagaggtgtagttgcgtgtgggaaaagtaagattgtcggttttttaagtatagttgtttgagattttgtttttaggtgtcggtttgagggttttggggttgtttttttttaaagattttattggtttaaatgttgtttggaaaagataaacgagaattaggtcgcgtttttaaattttggtttcgggatttatatgaagtttttcgggggtttttattgtggtttgagttatgttgaatgtagttttattgtaaggtttaggttgtttgtaggttgttaggtttagttcgttgtattttgattagagtcggacgtttgttttttaggttttaagtttcggttgggttcgaattgttgacggagggattaatttattttagatttaatttttggttttcgaggagtttgaattaattcgtaggtcggagttattttgatcgattcgaacgtttttttatttttagtgatttagggtttatttattgcgcgttttttttaggtggtatgatgtttttgcgagtcgtttttagttttgtggcgtttggcgaattttcgtatttgagtagcggacggggcgatagggggttggtgcgttgtaaagtcgaggagttgcgtttttagtttgtcgtttttttcgagtttatttcgttatttattagttttcgtgtcgatttcgagagcggagattggtgttgtatagttttagttaatttttcgaaaataggaagcggaggttgggagtagcgggttagcgtcggagtcgtagaaaatttttcgtagttttcgagttttttagtcgtttttttcggttatcgtattttgttatagcgttatttataggagttagattagatcgcgtatttattgtagtttttgataaggttgggaatcgtttttgaaaatttatagaattttaaagttcgatatttttggtttttttttttagatttttttgtatttttaattttttattgattttaaggtttcgtattattttttattatgttttaagggaaattcgattatgtttttttacgatttatcgaaaatttattttttatgttttatcgggcggatttttttgcggtttttaggggttatttaaggatattggttgtgagttgtttttgcgttagggcgggagagttggagatagtaaagaagttttgtagggaagggtgtggggagtgatggatttatttttttttagtttattttattatttgttgagggtttacgttaaatataataattatattaaggaggtattattttagtttttattttataagagatattaaataagaatatagaagatatttggattaagcgaaattatattgttaattaatagggggaaatttgaattttattatgtttttattgttgttttttttatttttttaatttgtaggagtagtttacgttggagtttttaaagaagtttttatattttaggtgtttatattgaaagtggatatttttttatttatttttatattttagaagatagaatgtcgtttaaggtcggatttagaattcgtagtaaagaggatttgtaattttgttttttttattgttggttaagagtttacgtcgcggaggtcgtagttgattaggtgagggcgggagattgtttgttcgtttttttttggtttcggttatttagggcgtcgaggtgaggttcgtagttattcgggcggtgtataatatgttttaggagtttcgcggtcgagcggcgtatagaggagtaaggagaggatcggaagaatcgtgtttttggttgtaatttgtttttaagagtgttaagatatgttcgagatttttagcgcgtttttagagtattaatttaagtatcgaaaaaatttatttttgttttttcggggatttattttggggtatgtttgtgtgtgtttttttttaagattattatagtgggaataaattaggaggtgtcgagttgtaataaaattagaatttataattaatatagttagttgggtttaagtggttcggaagtgtacgtagtggagttagttggttttttttcgcggagttcgggttatagttgcgttttttttttttggaatgtattttggagttaggattaattttttttattttttgtaaatagcgaataaataaattattttatttataaaaaacgataacgataaagagattttagcgtattttgcgagaggtggtagttaggagaagagaaagtttaaaggttgttaggtgtaggggttatttttattgttttgggaaaatgtattttagtcgcggaattcgtttcgtggggattgggggtgcgttttcgaggcgggttcgagggttagaattgcgaaattttaagttagtgtttttaggtttcggataaaaattgcgatttatacgaggattttattgttcgtattttggcggggattacgaaagttttataggttagtaggaattttgcggttagcgggggtatttttgtaattttttgcgtagggattttacgttttaggtttttttattggttggggttggttttttcgggaattgggtaggttttaataggtttttttatttgtaggttgtttgttttaagaggcggatttgtggggtttagggcgaattttttttttttttttttgttagttagtgttttttttgtttaaaaattttatttttattaggattaacgaaagagttgattttttattttttttatagcggttgtggttttttagataagttgcgtgtttgagttattgggagaatagagtataattatttttttatggatacgattggaaggtagttttaggaaaattgttaaaggatttaataatgtttttaatggatatatagaggttaaggaagagaaatgtaaaaatgaaataaatataattttaaaagtgtttaattttttaataagttaggaggggtaaaatatagtattatttttgtagagtaaattaattttgttagtaggtataaattgttgtgtttttttttaacgagagagggggggaaaaggttgtttgtatatgatttatattttttattaataaaatgtttttaaattaatatgaattagtttattttttttggtgggggcgggaattaagtaagtgttgttggttttttttaatagatgtattgttttttgtatagaggtaaaaaataatttgtaaagtgttgtttatttagtgaagttatttatatatttttaaattttaaagatgtttaagtttataatgttattgcgtaatttattttggtagtgtatttaataaaaattatattattggtaggatatttaataaaaattagattaattagtaaggaagggtatagtagataaaaaggataaagaaattttttgagtagaaaatttagaaaaataaagaagggtttttagataatattaatttttcgtgtattgttttaatttttatagttttgtttattgtagtttttacg

SEQ ID NO: 57 - DNA, 9498 bp, Artificial Sequence
  chemically treated genomic DNA (Homo sapiens)
tatgtacgtgtagataaatcgggttttaggaggatgatttggtttatttttatttttatatgttttttttttaagttgaggaagaagagaggaatatgtatttaatgatattaatgcgttaggtattgtgttatgtgtttattttagtgtattttttataataattaatgggaaataaatgattatttttattttatagatggggatatcgtagtatagagaagttgagaatatttcgtggttttagttagtaagaggtagaggcgtattttgaatttgaggttagggtttgagcgttatggtattaggttgtgagggagtttattgagtattaatttcgtggtttaatgtttttttttttattttaattttgaacgtttttattagaatttaaggaggtagatagtagtgtaattttatttaagagtcgtcgaaatcgaggtttagagggttttagcgaaagggttgcgtttggttttaggtatttgggttgagttttttttttattatcgtagggcgggaattagcggagggggttggttcggatggggagaaaagtaattggagggcgtcgaggggaagagggagttcggatttgttagggcgtttttttggattaagggatgtttttttaaattatattattttatttcgtttagattttgggaaattcggtacgtatatattttgtataataataggtagggtgaggtttttaagtttcgaagatcgtttttttagcggaggtagtggttttgacgagggggtatagttgtacgcgcggggttttttttcgaatcggagtgtagcgtagtcgaggtttaggattttttatttattatttacgatgtttattagagcggggtaagggagaggaaagaagagggaagtagagagaaaaagaggttaggggaggtggaggcgggtagtgttaatttcgagagtttttaagtttcgaaattttgagaaggaagattaagaggttaaggcgtttgggaagtagtaggtcgttagtaaatatttgtaagatggatggataattgggtgagtgagtgaatgggttaattattagtttttttgatttttgttttttttatttgtaaaacgggataatattatttattttatacggtgggtatgagaattttatgggtaaattttaaattgtttagtatatattaggaatttttaaacggtagttgttgttacgaggaatgggtttgtaagttttggttgtttagtagaaatgtattgaaggatttttaggtttggagggttattttgaatagtcgttattttaaaaaaaatattttataagtttttttagacgggagggttggaggaagagtgggttaagttatattttttaaatgaaagaaagaaaggtaagcgtggggaggaagttatttcggattgagaaggtagttattgtttttatttttatttcggagcgcggttgagggaggtggggtaggggttatttgggtttcgttttggtagttttttattttttttagggttcgtttgggcgtttggaggcgttttttcgttgcgtcgcgggatcggattttggtggatagtttgggcgtgaggttaggagcgttttggaaatgggtagtttggcggtagtcgggtcgacggagtgtgtgtgtgtgtgtgtgtgtgtgtgtgtgtgtgtgtgtgtggtggagaggggaagttggagtagggttaattttttgttttagtttagtttagggttatttttttatttaggtagttcgagttgggataggacggagaggttgggatttttggggtggtatgggggaagggaagtttacgaagaagaaagaatcggaaaggtttggcgggttggagttagcggggcggggcggattgggagaggttaggttaggttcgggtataaaggttgtggagggggcggtcgtcgcgggcgtagaaaggcgcgtcgttagttgttgtttttttttatttttcgggtcgtttttgcgagttttcggcgcgtgagtacgtttgcgcgcgttcgggttttttttggtaggttgtttgtaagatgagtgaagaagtaggtgggggagaggggaggtagcgagcgagagggcgaggggagcgcgggcgttgagtagcgtttatttggagagcggtaagtaagttagataagtttgattttatgttattcgttgttattttgttaggagcgcgaagatgatggttatgaattttaagtagtttttcggtatgtattcggtgttgtaagaatttaaattttttagtttgtattttggtttcgaggttatgcgtcgagtttgttttttagtttcgtaggtacgtagtggagtataattatcgttttaaggtatattttttgataggtattagttttatgttttttttatgtcgtttagaataatcgtcgttgtttgaatttttttttttgtttttttcgcgttttttttcggcgcgtttttttttttatttatgtttttgatttatacgtttgttttagtagagtcgttgttttcgtattaatttttatgatttgggttttgaggagaggtatttcggttgtttgaaaatgtgttttaattttgtgttgatagtattttttattgatcgtgttgtgcgttttttcgtttgtagttgtagggtaatatatttggaagttttgatgagagtttgttggtacgcgtcgaagttttggcggcggtggatatcgttttttacggtaagaattattcgtttaagttcgacgttatttattatattatgagtagcgtgttttgtacgtttatttcgtttatcgtgtttattttttatttagttgcgtttattttatatttttattacgtcgtgtattagggtttcgaaggcgatttgttggagtatatttcgtttacgttgagtgtgagcggtttgggcgtttcggaatattcggtgatgttcgtatagatttatttatattatttgggcgttatgggttatttgtattaggttatgggtatgagttattcgtatatcgtggttttttatagcgttatgtttgtatgttttagcgacgtggagttagattcgcgcgagttggaagttttcgtcgagcgttttaagtagcggcgtattaagttgggggtgatttaggcggacgtgggcgcggttttggttaattttaagattttcggcgtgggttcgttgagttaaagtattatttgtaggttcgagttttttattttttcgtataataatatgatcgtttttaagtcggtgttttaggtttggttggaggaggtcgaggtcgtttatcgagagaagaatagtaagttagagttttttaacggtagcgaacggaagcgtaaacgtacgtttatcgcggcgtcggagaagcgtttattcgaggtttatttcgttatttagttacgttttttatttgagaagatcgcggttatcgttgagaaattggattttaaaaagaacgtggtgagagtttggttttgtaattagagatagaaatagaaacgaatgaagtattcggttgtttattgattgcggtagggcgtagcgtcgggagtcgggagagtttagtgtttatttttttcgggttcgggggatggttatcgggaattttaaggcgttttttaggtaggttaggttttttttttcgaagttatagattttttttttttgtttcgtttggttgttttcggtttttttttttttttttttttatttttattaaaaaaattttggcgttgggaaaatattgtagaagggcgggtttgagtgtatttgtgttgttcgtggtgttgaaatttgttttcgcgtaggggtcgtacgattttagagtaggagttttaaagtagaggatagttaattggtttaatcgttcgaagttagggtgaaaatgttattttgttaagcgcgattaggtaaagggtgaagggataaaaaggaagtgattaataataatataaagtttaggatatttaagggggatataaatatgtattggagatttattagagtatataaaatatatgtatgtttttaaaggatagttttatatttttttttttgtttaaattttatttattttattttttggtttggcgtaaatttttataaggtagtatgaagattaggtttagggaaagtatgtagggagttgcgggttttaagttgttattttttcgtggtaagtagggttttaaaataggtgggtttagtttggcgattgaaaattttgggatcgtttggttgtttgtaattagttgttagtattagttttggttattttttattatttattggtgtttgaggggtaattattgtttgttggagagcgggagtttgtagtatttataatcgttgaggattttttgattttagttcgttgtttttgttagattgttagtttagcgtgtagtcggttgttggaaaacgattgtaatttttttgtattatatgtaagtttttttaatacgtttaatttttttgtatttttgttattattgttgttgttaatatcgtttattattattatttatttaattttgtttttttttattttttttatgtgggtgtttttcggtggaagtttatttatagttttgtgagggaagaggagtgggattatgggtttgaattttttttattttgtttttttagtttaaattttattttattttttcgttgttttatgtagtttgtgtgttgttgtgtgatttttggttttattttttgaatagatataaataaaatattaagtttttttttttttttattttttgaattaatttttaaaataaatgttttattttttaattcgaattaaagtggttttatttttttttagaggttaaggggtattagttttgaaaaggatttaaaaaggagaattttaaagggttgggttgttagtttttgttgtttagtttttagttattttttttttttattttttttttatggtagatttatttggagtttttcgtgggagattttgcggtttgtgtttgaatttgaggttttaaggtatttttttttatgtttttttgtttgttattatgagattttgtttaatttgatttagttagtaaattttgaagtcggattaatagaaattcgagtttttaatgtttttgtttattggtagaattattttgaggttaattttttaatttttttaagttttttttaataagattgtttgtttgtagaatgaagggattaacgtttattttataaggttattgttaggattaggtgagattgtttatttaagacgttaattagtgtttgggttttgtaggtaataaattattttaaaagatttaaagggtttgaaaggaggtgaaataatagaggtaaagagggagaaaagtgttcgttgggatattttagtgggatttatttagagttttaaatttatttgaaatttttatttaggttgttatttattttggggtttatttcggtttttttgtgggggtattgttataattgttgtaaagcgtttagtatagtgttttgtatatagtaggtgttttatagacgttagttttttgttttttttacgttttttttttttatttgcgagttgtagaaacgtttttttgatttaaaatttaatgttttaagtttaggagttatttgtatatttttttgtttcgtttttaaagagttgcgggttattaaattacggggtcgaaattcggagtagagtgggtttgtttttcgcgtagtgcgatattttttatcgtataagttaatttgcggattttttttagttttttgggttttagttttttattttcgttttgtataatagttttagcgatttttttatttttttttttatcgggtgttttttaataataaatgtttttatgttattatattatattgtgggttttgaaaatttaaaatacggttgatgtaatattaattgtttatagtggtataaaatatagggtaggagtttagtcgggttgtagaggagataatcgtgagcgtttcgcgtcgaagcgaagcgttttagaaggacgcgtttttgcgggttgtaaggttttttgtaggtaagaagagttttcgtatgttcgggttttggagagaatcggaaatttgtttttatttttttttcgaaaagttttttgtcgttatttatttagttttttttttttttttaattgataattgtaaaagtttgggagatttttacggagaggatgagaggagttgttttttgagcgtaaggtttgttttaagacggtttagtagtattaggtttagttttcgagttatgtttttgagtttagttttttttaggcgtttgagacggtgatgcgtaggagtatttttattagtttttacgtgtaggtcggagttgtagttcggttagcgaagcgttttattttttttttttttttgagtgcgtcggaacggcgtcgtcgttttatttttcggtttgttttaggaagtaattggagatgtggtttttttaggattgtgtagtcgtttttgttattcgtttggcggaggtatagatttttcgggggaggggaggtggtattagtaggtttggggtttatataaggttagtatgtattcgaatcgtgtgattttggataagttatatcgtttttttaagtttttgttgttagttgtaaaatttttttaaatttattttgaagagtaattgagggtgttttttaagattatttggagtaggtttttatttttttaattttgttagtttgtaatacgtacggtttaagatttagttgagagtttttttaatttgtattaagagaaagtgaagttagtatttgggggtgtttgtatggaaatttgtatcgggttttcggagggtgggattttgagaattatttggttggaataggggttttatttagaatgagttaggtatatatattttagtatgattaaagttttggtaggtagaatttggtggtaggagttttgggtttttgaacggtgttatttttggttagcgattttttttttgtgtgtttaagtagttttagttttgtttattattttatgtttagtattttgtttaaggtttggtttagagtggtagatattagatgtttgttgaatgaatgaattaggtttttgttttgtaaaatgaaagtattttttttagtcgaattttttttggatttaagggattgtagggaggaatagagttattagggataggtaagtttttttgggaatggggatcggggtaaggcggtggtttgtattataggtttttatttaaggtagttagtgttttttttgtttaaatagaagagattgtgttttattttttggtggttatgggtatataggggatgttttgtgatatggtttttggaatttagaggaagagttagggaggggggattagggagtgatcgttgttttgtttagtgtgtttgacgtttgagttttagtttttttattgtttttttgagatggaaatagtttcggttttggaatggatatatttggggtggaataattgttttattttttatttaagtgattttattgttttgatttttagtgtttttatttgtaaaattggaaaaattggaaaaaagatttttttaggattgttttgatgattaaatgagattacgtaaggttagggtttgatatatagtaggtattaatagatatttcgttgttttaaaatattttttgtatttagaaaagtgaaggtattgttgtggggtaagtttagggtttggagttaagtggaattaatattttttttttgtgagttatagtttggttagggtagtagtgtttattagttttcggagtggttgttacgggtaagacggaagtttaaaagaaatcgttttgtatattgtgcgttttagttacgtaaggaacgaagtattttttttttgggagtgtttggtgcgaatatatagtttttattgagaagtttggtttcggttagcggttttaggagttcggaattttttttttggcggaatttcgggtattatttagttttttcgaaggttttagatttcgcgttgttttttttttcgaggaggggcggggcgttagagggtaaaggagaagtaagggttttggatttttttttttttttagcgaatatttttttttcgttttgtttttattttttggtttcggcgttagaatgtttgagtcgaaggggtagaacgtttaaaagtcgtgtttgtttatttatttatttatttatttatttttattttttaaatcgaagaaggtagtgaggtttagagagtaggacggatttagttggttttttttatttaaaatagtttttttttaattacgttattatatcgttcgttttattttttttttagtttttaagattgtttgatagtatttatttagtttatttttgtttttttgaatttaacgtagggtttcgtatagaataagcgttttataaatgtttgttggataaatgattagtgatgatatttaaaacgtatggcgggatttttttatgcgaggtattgttttaagcgttttagcgtattcgtttgttaatttttaaataatattatgagtaggtataatttttaattttattttatagatgagaatatggaggtatggagagtttatgtaatttgtttaggataagttatgaatatagttatttagtggagagatttggtaaaaattcggtgtttttgtttttttcgtttttaagtgagattatttttggttggggtggggaagcggatcgtttgggagtgaaggaggagtaggtgagttcgatttggtattagattaggtagcgcgagtagaggaggtggtgggagtcgagaacgttcgttgttttcgtcgggtttcggagtttttacgtttttgtgtttcgcgcgttattcgcgtttttcgttttgtttgtgtgcgtttgttcgcgtgttttttatttagttttttttagtttttttttagtttcgcgggcgcgaaattttggtttttatgtgtcggagcgagggggttcgcgttttcgggcgcgcgtagagtcgttttttttttttttttttttttcgtagagcggcgggagttttcgcggtaatttcgtttcggcgggtagacggagttagcgaggatttcggcggataaattagtttttttttcgatcgttttttttcgattaagttaggttttttttgttttttcgacggcgttttcgtattagcgcgatttttagggtttttcggttgggttagggttcgttcgtttttttcggcgttttcggataggggttttttttcggttgcgtttcggtttgaggagttttttggatcgcgggaggggcgattgtcgggttcgcgcggtttagaattttttttacgcgttgtttatatttttttttgtaaattgttagatttttgtttttttttttagtttagttttgcgtagttttgtttgttattggaggtaaattgggatagaaattgcgttcgtttt

SEQ ID NO: 58 - DNA, 9498 bp, Artificial Sequence
  chemically treated genomic DNA (Homo sapiens)
agagcgagcgtagtttttgttttagtttgtttttagtggtaggtaaggttgcgtagggttgaattgagggagggggtagaaatttgatagtttataaagaaaggtataagtaacgcgtggggaggattttgagtcgcgcggattcggtaatcgtttttttcgcggtttaggggattttttaggtcgggacgtagtcgaagggaagtttttattcggaggcgtcgggaggagcgggcgaattttgatttagtcggggagttttgggagtcgcgttagtgcggaagcgtcgtcgggggaataggggaaatttgatttgatcggaaaagagcgatcgaaggggagattaatttgttcgtcggggttttcgttggtttcgtttgttcgtcggggcggggttatcgcgggggttttcgtcgttttgcggaagagaggaaagaggggaaggcgattttgcgcgcgttcggggacgcgggttttttcgtttcggtatatgggggttagagtttcgcgttcgcgaggttggagggaagttaagaggggttgagtgagagatacgcgaatagacgtatatagataggacgggagacgcgagtggcgcgcgggatataaaggcgtggaggtttcgaagttcggcgaggatagcgggcgttttcggtttttattattttttttgttcgcgttgtttaatttggtgttaaatcggatttatttgttttttttttatttttaggcggttcgtttttttattttagttagaggtgattttatttgagaacggaagaagtaaaggtatcgggtttttgttaggtttttttattaaatggttgtgtttatgatttgttttgggtaagttatataaattttttatgtttttatgtttttatttgtaaaatggaattaaaaattgtatttatttatggtgttgtttaggaattaataaacgaatgcgttaaagcgtttggaatagtatttcgtataggggaatttcgttatacgttttagatattattattagttatttatttagtaaatatttgtagagcgtttgttttgtgcgaggttttgcgttgagtttagggaggtaggggtgaattgggtaggtgttattaggtagttttaaagattaggaaagaaataaaacgggcggtgtgataacgtgattggagaagagttgttttaggtaaaaggagttagttaagttcgttttgttttttaggttttattgtttttttcgatttaaaaaataaaaataaataaataaataaataaataaataaatacggtttttaggcgttttgttttttcggtttaaatattttggcgtcggggttaaaaagtgggaatagggcggggaagggatgttcgttgggaaggaggaggagtttaagatttttgttttttttttgttttttggcgtttcgttttttttcgggaggaggagtagcgcgaagtttggagttttcgaaaaggttgaatggtgttcgggatttcgttagggaggaggtttcgggtttttggagtcgttgatcggggttaagttttttagtgggagttatgtattcgtattaggtatttttagggagagaatatttcgttttttgcgtagttgggacgtatagtgtgtaaagcggttttttttaagttttcgttttgttcgtgataattatttcgagagttgataggtattgttattttgattagattgtggtttatagagggaaaatgttgattttatttgattttaagttttgaatttgttttataatagtgtttttatttttttgagtataaaaaatgttttaaagtaacgaaatatttattaatgtttattatgtgttaggttttggttttacgtgattttatttaattattagagtaattttgagagagttttttttttagtttttttagttttatagatgaggatattgagggttagagtagtaaggttatttaagtaagagatggagtagttattttattttaggtgtgtttattttagagtcggagttgtttttattttaggaggatagtaaaagaattggaatttaaacgttaggtatattgggtagggtagcggttattttttggttttttttttttggttttttttttaggttttaagggttatgttatagagtattttttgtgtatttataattattaaagggtgaagtatagttttttttatttaaataagaaggatattggttattttgaatgaaagtttgtgatgtagattatcgttttgtttcgatttttatttttagggagatttgtttatttttgatggttttgtttttttttatagttttttgaatttagaggggattcggttggaaggggtgtttttattttataaaataaaaatttaatttatttatttaatagatatttagtgtttgttattttaggttagattttgagtagagtgttggatatgaagtagtgaataaaattgagattatttaggtatatagagaggaagtcgttggttagagataatatcgtttaggagtttaggatttttgttattaagttttgtttattagggttttagttatgttggaatgtgtatgtttagtttattttagatgaagtttttgttttagttaggtagtttttaaagttttatttttcggaggttcgatgtaggtttttatgtaaatatttttaaatattgattttatttttttttggtataagttaaagaaatttttagttgagttttggatcgtacgtgttgtaagttgatagaattaggaaaatgaaaatttgttttaggtgattttaggaaatatttttaattattttttaaaataaatttggggaagttttatagttggtagtagaggtttagagaggcgatatgatttgtttaaggttatacggttcggatgtatattagttttgtgtaaattttagatttgttagtattattttttttttttcgagaggtttgtgttttcgttagacgagtggtaaaggcgattatataattttggggaaattatatttttagttgttttttgaagtaagtcgaagagtgaggcgacggcgtcgtttcggcgtatttaggaggagggaaagggtggagcgtttcgttgatcgggttgtagtttcggtttgtacgtaggaattggtgaaaatatttttgcgtattatcgttttaggcgtttgaagaagattaggtttagaggtatggttcggagattggatttagtgttattggatcgttttggagtagattttgcgtttaggaggtagttttttttatttttttcgtaaaagttttttaaatttttgtagttgttaattaaaagaaaaaaaaagattaaataaataacggtagagaatttttcgaaaagaggatggaggtagattttcggttttttttagagttcgaatatgcgaaggttttttttatttgtaggaaattttgtagttcgtaaaagcgcgtttttttggagcgtttcgtttcggcgcgggacgtttacggttgttttttttgtagttcggttgggtttttgttttgtgttttatattattataggtaattaatattgtattagtcgtattttaaatttttaaaatttataatataatgtaatggtataagggtatttattattaaaggatattcgatggagagggaggtggaggaatcgttggggttgttgtgtaaggcgggggtaaagggttgaggtttagggagttgggggagattcgtaagttagtttatgcggtagggggtgtcgtattgcgcggagggtaaatttattttgtttcgaatttcggtttcgtggtttgatgattcgtaattttttgaggacgaagtagggaaatgtgtagatgatttttggatttggagtattaaattttaaattaggaaggcgtttttatagttcgtaaataaaaagagggagcgtaaagagaatagggagttggcgtttatggagtatttattatgtatagggtattatgttaggcgttttgtagtagttatagtagtatttttataaagaagtcgaggtggattttagagtgaataataatttggatgagaattttagatgaatttggaattttgagtgggttttattagagtgttttagcgaatatttttttttttttttgtttttattattttatttttttttaagttttttgaattttttaaaataatttgttgtttataaaatttaagtattagttgacgttttaaataaataattttatttagttttgataataattttgtgaaataagcgttggtttttttattttgtagataagtaattttgttggagaaggtttagagaaattaagaaattagttttaggatggttttgttagtgagtagaggtattggaggttcgaatttttattagttcggttttaaagtttattagttaagttaaattgagtagagttttatgatggtaggtagggaagtatggaaggaagtgttttgaaattttaagtttagatataagtcgtagggttttttacgaggagttttaagtgagtttgttatggaagaggagtggggagaagggatggttgggggttgggtagtagaaattgatagtttaattttttggggtttttttttttaaattttttttaaagttagtattttttagtttttgagaaaaaataaaattattttgattcgggttgaaaaataaagtatttattttagaagttaatttaaggggtaaagggaaaagaaaatttaatattttatttgtatttatttagagaatgaaattaaaggttatatagtaatatataaattatatgaaataacgaaaaaataaaataaaatttgggttagaggggtagggtgagaagggtttaggtttatggttttatttttttttttttataaaattataagtgaatttttatcgaaagatatttatataaagggaatggaaagaagtagaattaaataaataatagtaatgaacgatgttaataataatagtaataataaaagtgtaaggaggttagacgtgttgaaaggatttgtatataatgtagagaagttatagtcgttttttagtagtcgattgtacgttgagttggtaatttggtaagagtagcgagttggggttagagagtttttaacggttatgaatattataaattttcgttttttagtaagtagtaattattttttaaatattagtaggtagtgaaagatggttagagttggtgttggtagttgattataaatagttaagcgattttagaatttttagtcgttagattgggtttatttgttttggagttttatttattacgaaaaaatggtaatttggagttcgtaattttttgtatattttttttgaatttaatttttatgttattttatgagaatttacgttaaattaaaggataaggtgaatagaatttaggtaaggaagggagtataaggttattttttggaaatatatatgtattttatatattttaataaatttttagtgtatgtttgtgttttttttagatattttagattttgtgttattattgattattttttttttatttttttattttttgtttaatcgcgtttagtaaagtggtatttttattttagtttcgggcggttgggttaattgattgttttttgttttggggtttttgttttgaagtcgtgcggtttttgcgcgagggtaaattttagtattacggatagtataagtatatttaggttcgtttttttgtaatatttttttagcgttaaaatttttttggtgggaatagaaaggaaagagagagaaggtcggaggtaattaggcgggataaagggggaaagtttgtggtttcggaggagagagtttaatttgtttaggaaacgttttggagttttcgataattatttttcgaattcgggagggatgagtattaggttttttcggttttcgacgttgcgttttgtcgtaattagtggatagtcgaatattttattcgtttttgtttttgtttttggttgtagaattagatttttattacgttttttttaaggtttagttttttagcgatggtcgcgatttttttagatgaaggacgtggttggatagcgaaataggtttcgagtgaacgttttttcggcgtcgcgatggacgtgcgtttgcgttttcgttcgttgtcgttgaagagttttggtttgttgtttttttttcggtaggcggtttcggttttttttaattaggtttggagtatcggtttgagagcgattatgttgttgtgcgagagagtgagagattcgaatttgtagatggtgttttggtttagcgagtttacgtcggggattttgagattagttagagtcgcgtttacgttcgtttgggttatttttagtttgatgcgtcgttgtttgaagcgttcggcgaaggtttttagttcgcgcgggtttgattttacgtcgttgaggtatgtaggtatggcgttatgaggggttacggtgtgcgggtgatttatgtttatggtttggtgtaggtggtttatggcgtttaggtggtgtggatggatttgtgcgggtattatcgagtgtttcggagcgtttaggtcgtttatatttagcgtgggcgagatgtgttttagtaggtcgttttcgaggttttggtgtacggcgtggtgagggtgtgaggtgagcgtagttgggtgggagatgggtacggtggacgaagtggacgtgtagggtacgttgtttatggtatggtaggtggcgtcgggtttgaacggatggtttttgtcgtgggagacgatatttatcgtcgttagagtttcggcgcgtgttagtaggtttttattaaagtttttaaatatattattttgtagttgtaagcgagaaggcgtatagtacggttagtagggaatattgttaatataggattaaaatatatttttaagtaatcgagatgtttttttttaaagtttaggttataaaaattaatacggaggtagcggttttgttggaatagacgtgtggattagagatatgaatgagagagagagcgcgtcgggagagaacgcgggggagataaggagaggggtttagatagcggcgattgttttgggcgatatgaaaaaaatatgaagttagtgtttgttaaaaaatgtgttttagagcggtaattatgttttattacgtatttgcggggttgggagatagattcggcgtatggtttcggagttagagtgtagattggagaatttgggtttttgtagtatcgggtgtatgtcgaaaggttgtttggagtttatggttattattttcgcgtttttggtagggtggtagcgggtgatatggaattaggtttgtttagtttgtttgtcgttttttaagtgagcgttgtttagcgttcgcgtttttttcgttttttcgttcgttgtttttttttttttttatttgtttttttatttattttataagtagtttgttaggaagggttcgggcgcgcgtaggcgtgtttacgcgtcggggattcgtaggggcggttcgggaggtgaggagagatagtagttagcggcgcgtttttttgcgttcgcggcggtcgttttttttatagtttttatattcgggtttggtttggttttttttagttcgtttcgtttcgttggttttaattcgttagattttttcgattttttttttttcgtggatttttttttttttatgttattttaaaagttttaattttttcgttttgttttagttcgaattgtttggataaaagggtagttttgggttgagttggggtaggaagttgattttattttaattttttttttttattatatatatatatatatatatatatatatatatatatatatatttcgtcggttcggttgtcgttaaattgtttatttttagggcgtttttggttttacgtttaagttgtttattagagttcggtttcgcggcgtagcgaggaggcgtttttaagcgtttagacgggttttggagagggtgaggggttgttagaacgaggtttaggtgatttttgttttattttttttaatcgcgtttcggggtagaggtaggggtagtaattgtttttttagttcggggtggttttttttttacgtttgttttttttttttttatttgagggatgtaatttggtttattttttttttaattttttcgtttaaggaagtttgtggagtattttttttagaatagcgattgtttaggatggttttttaggtttgggagttttttagtgtatttttgttgggtagttagagtttgtaagtttatttttcgtgataatagttatcgtttaagagtttttaatatgtgttagataatttagagtttgtttatgggatttttatatttatcgtatggagtaggtgatgttatttcgttttatagatgaggaaaataaggattagaggggttaatgattagtttatttatttatttatttagttatttatttattttataaatatttattgacggtttgttgttttttaggcgttttagttttttggtttttttttttaaagtttcggaatttgagggttttcgaggttagtattgttcgtttttattttttttagtttttttttttttttattttttttttttttttttttttttgtttcgttttagtaaatatcgtgaataatggatggggaattttggatttcgattacgttgtatttcggttcggagagaaatttcgcgcgtgtagttgtattttttcgttagggttattgttttcgttgagagagcgattttcggggtttagagattttattttgtttgttattgtgtagggtatgtgcgtgtcgggttttttagaatttgaacgaggtggggtggtgtggtttaggggaatattttttagtttaagaggacgttttgatagattcgggttttttttttttttcggcgttttttagttgtttttttttttattcgagttagtttttttcgttggttttcgttttgcgatggtgggaaaaagatttagtttaggtgtttagagttaagcgtaattttttcgttaaagttttttgagtttcggtttcggcggtttttaaatggaattgtattattgtttgtttttttggattttggtgaagacgtttagagttagggtaagaagaaaagtattgagttacgaaattggtgtttagtaaatttttttataatttggtgttatagcgtttaggttttggttttagatttaaaatgcgtttttgttttttgttggttgagattacgagatatttttaatttttttgtattgcggtgtttttatttgtaaaatgggggtgattatttattttttattgattgttgtgaggaatgtattgggataagtatatggtatagtgtttggcgtattgatattattgaatatatgtttttttttttttttttaatttaaagagaaagtatgtgagagtgggggtgggttaagttatttttttggaattcggtttgtttgtacgtgtata

SEQ ID NO: 59 - DNA, 12727 bp, Artificial Sequence
  chemically treated genomic DNA (Homo sapiens)
gggtttttttttcgtttgttttgggtttgatgtggttgtatttcgtgttattagaggagttttttttttatttaagtgtgtttttttgtttagtttttttcgtagatttttgttgggttgagttttttttgtttttaagagttaggagtggtttttgttgggatggaatgattcgtttttggggttgttttatgagcggtttttgtgaattcggattagtttcgatgtgtaaattttatcgtttggtttttagcgaatagatatagatttttgttattttttatgattttatagtttatgggattgggtttggggtagtgttagaggtacgtatggaggtgtgattttaggtgagttttgcggaaaatttttggtttattcgtgagttacggatagaatatgtagatttaggttttggtgatataagtttcgtattgttaaaatcgcgtgatttcgagggttgattggtttgagaattttggatggcgttttcggttatttttattttttattttaattttttgggtttcggttagaatttatagttcgtgttcgaagagcgtttttcgtttttggtattttattttcgtttagttttagggaaaaggggagagggtagttttttgtagttagaggaagagtatattttttttggttgttttattttttgaagtagggcggttagttgaaggaggatatatttttgaggggtttagaggttgtttaagtttttttttgttttttgaagattgtgtattgagttgggcgtagttttcgggaattgtttttatttagattgttggggggcgggggggtaggatgagggtagagtcgagaggttgtttaaggtttgggagagagaaaagttttttttaggattcgattttggtttttagtaatcgcgatagttaaaaacgggtgtttcgtttcgataatagattttcgcggattttttggtatttggtttattagcgttcgcgaattttgtttcgggagatttattgaaattcggatgtttaagtcgggaggcgcgtagtaattaggaggatgagagggtcgggtttgggttaggaaagcggttttttaaaatagatgttagggggattgtagtttcgagttatgagaaaaaagttaaaggcgagatgatacgtattgaattggggtaaatattggaagaggagataaaattgcgtgtttgagtatcggggtgcggggagggggggataaaattcgtatttagtgtaaattaaaattttgggagtaggtgggggttgttgcgcgttttttatttttagtttttttattaaggattttgagtttttatgtatttttgttttttggttttttttttttttttcgttcggtcggtgagaggcggtcgtcggcgttttagtagtagttagatgttaggcgaagttcggagcgcggagcgcggggaagggaggggaagggaggggaggggaaaggaggggtggggcggggagcgcgcgcgggttcggttagtgcggggtggtgggcgggttgagttcggggacggcgcgggaggggggagggaaggggggtagttgtgggtagggagtcgggttcggtcgttagtattaaagatggagaggcgtcggggttttgtaggggagggggttcggcgttgacgtgggacgcggcggaggcgtagtagtcggtggtgatttgttaatttcgtagtagagaggagttgagggcgatgagagcgggtattgcgaattgtcgggcgatgttgtcgttgtcgtcgtgatacggagagtaatagttttttagtaatattttttttcgatataggtatatatttttcgataggtacgtatatttattttatagtgttcggttcggttgcggtgagtgaggggtcgggaagaggcgtatcgtttagcgagcgtcgcgcgtcggggtttttcggggttggagaggtttggggggcgcgcgttcgtttcggttattcggtcgttgggtttgtgttttttttatttggcgtgttttttttttgtcgttgtagtcgtcgtcgttatcggttgggggtcggttagaagggggagtttcggttgttagtttgggcgtagttgtttttttagttttttttttttagggtacggtcggggtgagaggtggggggcgtagcggtgtgcgggggttgagggcgtgagtagaggggtcggggattcggaggttttgtatcgttaggggttggcggagtaatagagttcgtgggtgtttttatgtatgcggatcggtgcgcgggcgtaagataaggttgtggtttatttatttgtgtgtttattcgtcggtcggttgggaagttagaatcggaggagttgacgagtagatttgggggcggaggggagtaggattgggattgtttacgttttgtttttttttgagaaaacgtggtgggtttttttttgattggatttgatttttattttttttttgtaggggagggagggaagttttagagggtttgtagcgttgcgggtttttttcggttttcggcgggatcggcggtgatatcggagttcgtcgtgcgttttcggtcgttttcggtgggtgtcggtttttgtatttgatgcgttcgggatgttttttttattttggcgcgttcgtcgttagttcgtatagcgtttcgtatattttcgtacgcgtttgaaatgcgtacggtttcgtcggttcgcggaattattcggacgtacggagcgtttcgtatcgattcgttcgtcgttttttcgagacgttcgtatcgtgtttgggtcgggcgcgttggtcgttggcgtcgttggttagaggtttgggatttagtcggtcgtttttagggggttacggttttgggtcggagagggagggcgggtagattttttttcgtttttttttttataattcgttgcggggtttttgtgtttttttttcgtcgcggggcgggttcgttttttttgtcgttttcgtcgcggagtttagttcgttcggattgtcgtcgttttttttcgtttttttcgttttttttcgtttttagtttagtttttttttttttaggagtttagtttttcgggaaaagttgtttttttaagtttgttgaagtcgtttttaagtttcggtgggggtcgttgggaattgggggggtgtgagagcgcggtcgattttcggagttcgggcgggttatcgtcggttttttttcgcgtcgtttggttggacgttgtagttagcgttagtcggatcgcgggcgtcgagcggcgggtgggggagacggttgttcgtgggcgtttagattttttttaggatttaaaaggtttgttttagggcgttaagtttttatttttttggttgtttttttttagtttttagaaatttcgatgtttgcgggaaagtacgcggtggttcggttcggttgaatgtttattttaattttgacggttttcgtttttatttcggggcgggtagtaaaaatgttttgattagtcgttttgtgaattttttttgcgtgagtttggtggtttttgaattgatagagttttttttgggggtggaggtaagtaagtagtgttcgaagagtgagggagagattttgttgttttttgtttttagtgtatttattgtaatattggtcgttgtaagatagatacggggagggttttgggtttgcgcggtttttttaatatttttgtaagcgaggtttggagtttaggagtttttttattgatttcgaataggttttgggagaggtttttgttttttagttttgtttttttttcgtattggttgtaatttatattataggtgttggtgttaatattatttttagcgtttttgagttatgtttagtattttttgttgtttttggttataggatttgtagattttttggagtttgtgggatatacgtggagtttatatatttagtttagtatgagtatttttggttgtaggggattatatttaattatggtttttttttatattttaatgatttattttttttcgttttttagatttttttgtttatcgggtagttgtgggtaggagggtaggtacgatattttacgtaagtgtgtgtgtgtaaatatatatatatttttttttttttttttgagacggagttttgtttttgttgtttaggttggagtgtagtggtataatttcggtttacggtaattttcgtttttcggttttaagtgatttttttgttttagtttttcgagtagttgggattataggcgggtgttatcgcgtttggttaattttgtattttttgtagagacggggtttttttatgttggttaggttggtttcgaattttcgattttaggtgattcgtttgtttgggttttttaaagtgttgggattagaggcgtgagttatcgcgttttgttttatatattttttttgtttgtttttggttggtgtatatatatatagtttagattttatattatatatataataattttgaggttttcgtgggtagaaatgatttaagttagtgtgtgggttgtgtgtgtttttgttagtatttagggatggggataggttttgggtttgttagtgttttgtagttttgagaatagtagaaggttagaggttaaggttgatggtgagaggatagtttttgcggaggagagtttagtgtttatagatttttgtggttatggttataggtttttggtttttaatgagtttgattttgtttttggggtttttgtagtgaggtagagtttggaaaaattgtttaaagataaggtttgatatttagggggttggcgtgaagttgataaggaaggggttaaagttttgttaattttaagtaagtgtattttattataatgaatgttggttttgtttagggagtttttatttttagatatagagaaagttgaggatttataggattttattataatttttattttattttatttaatagatgttatagagtagtgaattaggtatttgttgtggtagaattttttttttatttttagtatttttggtttgaaaggtagatttgtagatttttaggaagttattttaattaaaatttttaagatttttttgttaagggtttggtaatagggaggagggggtatgttgtagtggttgaatttttatttttagggatattgatgaatttgttttttgtttttttattttttttgtttttttttttttttttttttttagttttttttattggtttaggaagtttatttagtttcgttacgtagagtttagaaggaaagaaagttttatgtttgagtcgaggggagtattatggatttgataaaaatgggtatgatttagttgtagaattttagttattttacggggttattgtgtaaggttaattagatgcggttggtcgggattttgtgcgatgtggttattatggtggatagttaggagttttacgtttatcggacggtgttggtttgtattagtaagatgtttgagatttttttttatcgtaatagttaatattatattttggattttttttcgttaaagattttttagtagattttggagtatgtatatatagttacgttgtaagttaaggcggaggatttggatgatttgttgtatgcggtcgagattttggagatcgagtatttggaggaatagtgtttgaagatgttggagattatttaggttttagacgataatgatacggaggttattatggtcgatggcggggtcgaggaagaagaggatcgtaaggttcggtattttaagaatatttttatttcgaagtattttagcgaggagagtgggtatgttagtgtggttggatagagtttttttgggtttatggtggattagagttttttagtttttattttatttggttttttagttatgagttttattaaggttgtagtggatagtttgatgattataggatagttttttttgtagggaattttttagttatttgtagggttcgaggagttaattttggttgggggtgggcggtattttggggtggttgaggtgaagacggagatgatgtaggtggatgaggtgtttagttaggatagttttggggtagtcgagtttagtattttaggagggatgggggataaggttgaggaaagaggtaaagaggggtttgggatttcgattcgaagtagcgttattattagtgttagggagttatattatgggcgagaggagagtgtcgagtaggtgttatttttagttgaggttggttaggtttttattggtcgatttgagtatttagtattttcgtttgagaagtatttgggtatttatttcgtgttgtttaattataaggttgacgttgtattgagtatgtcgtttttcgtgatttttggtttttacgtgtagtttgttttggttgtttttatggattttagtatttatggggggttgttgttttagggttttatttagagggagttgtttagtaagttgggggagttggttgtgggtatgaagttagagagtcggattatcggagagtagtgtagcgtgtgtggggtcgagttttttgataacgaggttgtggagtagtataggtaggtttcgttttagtttcgtatttgatgtaggatttgaggtttttatattttttttttatattttggttgtttttaagttaggggtttggtttttttgttttggtaatttgtgaaaaaattagaatattttttttaaagttttggcggggaggggagtaggttttttaaagtgtagtgagggggtttaggatttttttaaaaagtattaggggatatttatgggcgtagttttttaataggtttttttttttgttttttgtttttgggtttttgtttgttttttcggttgtttggtttgtttttttttgtttggagtgattgataaaatggagagaaggagaaaaggagtgggatgagggttttttgggttttgtatttgattatgttattaggttttaggttttcgggtttttatgtagtggtttttgtgaagatagtttgtttttttttgtagtttgggagaatgggagggtttgggggttgtttaagttataagagtagttgtaggttttgaattttatttttggtgaaagttaatttttttgttttgtttttttttttattttttgattttgtatatgtatttagggggaattgatttaaatgtaaggggaaaggatgggtataagagttttggttttgtagtttgtgaagttttatttttattttatttttgtttatattgaattaaatgtcgttttaggttagtattggttttttttcggttttcgtttttttttttatgaaataattatttattgagtttttatgatatgtttggtttagtattaagtattttttatgagttgtatttttattataatagttttttgagataggtaatgttttttttttttttttggatgtgaagtttcgttttttttgtttaggttggagtgtaatggtgtgatttttgtttatcgtaatttttgtatttcgggttaaggtgatttttttgttttagtttttcgagtagttcggattataggtacgtattattatatttggttaattttgaatttttagtagagacgggtttttatcgtgttggttaggatggtttcgaattttcgattttaggtgatcggtttgtttcggttttttaaagtgttggattataggtatgagttatcgtgtttagttggtaatgttttttttttatatggaataatattaaggtttagatgttaagttttttttttagggttatatagatagtaagaggtagagttggatttaaatttaggtttttattttttggtattttgttgttttttggagttatttagatttgaagaggattatgtttatggaatagagcgttttgaagattgtttataggaagtggagtaaataataggggggataagtagcgagtttgttttttttttttttgtttttgttataaattacgtgtttattattttattttttagtttttgggttagatgaatggagttaagaaatttagttttttgttgttattgacgatagtatttggttgtatattttgtggtttgttgttttgttgattttgggtggattttttattttttttttttttatttttatttttttgttgttcgtttaggtacgggggatgtgagtgagaggggttggggtggggatatttggaagttgattttattatttttagtcggaatttgttttgattttgttttttcgatagtttagaggtttaatttgtggaaagtgtggtagagttaaacgtagtcgattttttttagtgggtgcgaaaaataatcgttattaaggtgtgtttttttgatgtttgtatcgtttagaaatagattgaggttgtgtttgtttttgtttaaatttttttaaagaggaaattcgttttttaaagttgattagatagatgtattattttttcggatgtgaattatttcggttgtgtgttatgagaattgggtatggtgggaagtaattgtttttttggtttttattaggttttggtttttggttgtttttttttattcgagagggttataaaagatattatttttttgagatttttaagtttttttttagtaagatttttatttttttggggagagagggagagttggttatgttatattcgaaagagtttgggtattggaattggttatatttagtggtgagagtttgtgatatttatttaatttttttgggttttgttttatttattatatttttttttttttttttttttgagacggagtttcgttttgttatcgggttggagtgtaatggcgtgattttagtttattgtagtttttatttttcgggtttaagcgatttttttgttttagttttttgagtagttgggattataggtatttgttatttcgtttagttaattttttgtatttttagtagagatagggttttattatgttggttagaatggtttcgattttttgattttgcgatttatttatttcggttttttaaagtgttgggattatagttgtgagttatttcgttcggtttttatttattttttaaaatggagacggttaatagggttggtgttgaattaatgaagtaagatttagaaattattagagttgtgatgggtatatagttatcgtagcggtggagaattgattatttgttttttgtgttgtttaggttttatttttgtatggtttttattggttttgagttttagtgtgtagtgtttatagtgttattttttatgagggttgtgttgattgtgaggtggtgtagagaatgtttttgtttttgtgagtatatgatagtaagatattggttttggaatttttcgtgttatatgtgggttgttgataggaagaatgtgtttttgttgttgttgttgttgttgaggtagagttttattttgtcgtttaggttgtagtgtagtggtatgattttggtttattgtaatttttatttttcgggtttaagtgatttttttgttttagttttttgagtagttgggattatagatgtgtattattatgttcgattaatttttgtatttttagtagagatggggttttattatgttggttaggttggtttggaatttttggttttaagtgatttatttgtttcggttttttatagtgttgggattataggtgtgtgttattttgttgggtcgagaatgtgtttttgattgagggtggaaagttagtagttgtagtttaagaagttagagttaggggtagtgtttttgatgggaagtttgggggtttaaagaaattagaaaggggagaaaataattttgcgtgtgtttagtttttatttagattaatagtttttcgggttttagttagatgtattttgtagaaggtttttttttttttttttatttttaaaattttaggattaatgtgttatttttttttttttattgttttttgtttttttttaatttattagtagtttgagaaatgttatggtggaaaaaaaaaaataatagttttataattagtataaataaaaagttaagataaaaaaaaaaaaaaaattagaaggggagattttgaggttaggaagttatggtatttattggaaatatattagtgataaaataataggttatagggtttattttattttatttttaagttaataggtttgagtgttggtaaagattagatatttagtagttttttttgtatttttttttggggtgggggggtagaagggaatggagaggaaatgaaggcggattgttggtaagtgaggtaggaaggtagggagtttattatggaatgttatcggtaagtttttttatgatttgattttaagttggtgtggagtgaagggtaagttgttggtttaatagatagtgagaattaaatttagtggagttgtagagtttgttttttgtagcggatagtaagatgtataagtcgtttattgtaggaatgacgtgttgtaaaagggatgtagtgttaagtgtagttatggatgggtgggaagattagataaaggtatttaatgggattgatttatttaaataaattagaaggaagttagaatagtgggaagatttgatagataagtagtattttgtaggtagatgaaggagtaagttttgggtttttaaatttttattagtgtatttatattatagaggataatgtttgagggaggggaagattattttaggattttggaatattgggtttttttttttttattttaaaaggttggagtagttttgtatgtaggtttttttggaaatggtttaggaattagtttatttaggttaggagtatttgattatttttagagttacgtatatatgcgataagattgtagggaatagtatagttttatagatttaagtgtgaatatagtttttatttatagtttttagttttttatggtttacgtagtttggtttttatgtgtttttgaatttagtgttgtagaggtataatggggtttggtttttggattttatatagataagtatttaggttagttgtagtggatgttttgtatagatatcgtcgtaatttttgtttggtttttttttgtttttggagatggagtttcgttttgttttttaggttggagtgtagtggcgcgattttagtttattgtaagttttgttttttaggtttacgttatttttttgttttagttttttaagtagttgggattataggtattcgttattacgttcggttaattttttgtatttttagtagagatagggttttatcgtgttagttagtatggtttcgattttttgaattcgtgatttatttgtttcggttttttaaagtgttgggattataggtgtgagttattacgttcggtttattgtttggtttttgaagggatttttaggaattatagggaatgtttgagttagttttttggattcgtgtgtatagttttttttagaggttttgtggagttagttgtacggtgtatgagttttgtggttaagatattagagttttgtttggtttttggttttggttttttttagatggttagttgttttgtttttagtggttgattatgtagaaggttaataggtgttgattttggtttaggttatttttgggatttttgaggttttttgagatttttggtttttttttattatttcgtttagaatttttgatgttaaattaaattttgtttggaaaagggtatgttgtagaataatgatagttatagtaatgatattaataatattttttatcggttgtagtatttttttttttgtaaagtatttttaatgattttattttttttgtttttatagttttttttgagtgggtataggtttataattttatatttgtgataatgaagtttgaaaagttttgaaaattaaaaagtttgtagtaaatttatttagtggtaaaatttgatttgaattgatgtgaggttatatttattttgtttagtttgaatatttatatgttttgttgtaaaaatattaatgtgtttgattatagagtgttgttttagattttgttggggttgttaaatacgataggtgttagagtatttttttttttttttttttttttttttttttgagacggagtttcgttttgtcgtttaggtcggattgcggattgtagtggcgtaatttcggtttattgtaagtttcgtttttcgggtttacgttatttttttgttttagtttttcgagtagttgggattataggcgttcgttatcgcgttcggttaattttttgtatttttagtagagacggggttttattttgttagttaggatggtttcgattttttgattttatgatttattcgtttcggttttttaaagtgttgggattataggcgtgagttatcgcgttcggtttagagtatttttttaaagtttgaatagttttggtcgttgaagtatttgaaggttttggataagggattatgaacgattattattttttattgataaatgaggaaaatgagatttggagtaagtaagtgattttttatggttatatagttataaatgggtagaattaggtatttagtttgttttttaatttatagttttgggcgttttgtattaggttatataagaatatgagtattgtttttttgggttaaatttatttgatttagtttttggttgttattattatgtttaagatattattattggaggttataattattttttttgacgt

SEQ ID NO: 60 - DNA, 12727 bp, Artificial Sequence
  chemically treated genomic DNA (Homo sapiens)
acgttaaggaagatggttgtagtttttaatggtggtattttaggtatggtgatggtaattaaagattaggttagatggatttgatttagaagagtaatgtttatgtttttatatggtttggtgtagagcgtttaggattgtgaattagaaggtaagttgagtgtttggttttatttatttatagttgtgtgattatgggaagttatttatttgttttaaattttattttttttatttgttaatagagaatgataatcgtttataattttttatttaaaatttttaggtgttttaacgattaaaattgtttagattttagaaaggtattttgggtcgggcgcggtggtttacgtttgtaattttagtattttgggaggtcgaggcgggtggattatgaggttaggagatcgagattattttggttaataaggtgaaatttcgtttttattaaaaatataaaaaattagtcgggcgcggtggcgggcgtttgtagttttagttattcgggaggttgaggtaggagaatggcgtgaattcgggaagcggagtttgtagtgagtcgagattgcgttattgtagttcgtagttcgatttgggcgatagagcgagatttcgttttaaaaaaaaaaaaaaaaaaaaaaaaagaaaggtattttgatatttatcgtgtttaatagttttagtagagtttagggtagtattttgtaattaaatatattaatatttttgtagtaaaatatatgaatatttaaattaagtaggataaatatagttttatattagtttagattaggttttgttattaaatgagtttattgtaaattttttagtttttagagttttttagattttattattatagatatgggattatggatttgtatttatttaaggaaggttgtgagggtaagagagataaagttattagaggtgttttgtaaagaagaaaatgttgtaatcgataaaaggtattattaatattattgttgtggttattattattttatagtatatttttttttaaatagaatttagtttgatattagaggttttggacgggatgatgaaagaaaattaagagttttaggaaattttaaaaattttaaaagtagtttaaattaaggttaatatttgttggttttttatatgattaattattaaaaatagagtagttgattatttgagagagattaaggttaagggttaggtagaattttgatattttagttataaagtttatgtatcgtatagttggttttataaagtttttgggaagggttgtatatacggatttagaaagttggtttagatattttttgtggtttttgagaatttttttaagaattaggtaataggtcgggcgtggtggtttatatttgtaattttagtattttgggaggtcgaggtaggtggattacgagtttaggagatcgagattatattggttaatacggtgaaattttgtttttattaaaaatataaaaaattagtcgggcgtggtggcgggtgtttgtagttttaattatttgggaggttgaggtaggagaatagcgtgaatttgggaggtagagtttgtagtgagttgagatcgcgttattgtattttagtttgggagatagagcgagattttatttttaaaaataaaaaggaattaggtaagagttgcgacggtgtttgtgtaggatatttattgtagttgatttaagtgtttgtttgtataagatttagaaattagattttattgtgtttttgtagtattaaatttagaaatatataaagattaagttgcgtgagttatgggagattagggattataaatgaggattatgtttatatttaagtttatagaattatattgttttttgtaattttatcgtatatgtacgtaattttgagaatgattaggtgtttttggtttggatgagttggtttttagattatttttagagaagtttatatgtagaattgttttagttttttggaataagaaagggagggtttagtgttttagaattttgagatgattttttttttttttaggtattattttttgtaatgtggatgtattggtgaagatttgggggtttaaagtttgtttttttatttgtttgtagaatattgtttatttattagatttttttattgttttgatttttttttggtttgtttaggtaagttagttttattggatgtttttgtttggtttttttatttatttatgattatatttgatattgtattttttttatagtacgttatttttgtagtggacggtttgtatattttgttgttcgttgtaggaaataggttttataattttattaagtttgatttttattatttgttgagttaatagtttattttttattttatattagtttgggattaaattatggggaaatttatcgatgatattttataataaattttttgtttttttgttttatttattagtaattcgtttttattttttttttatttttttttgtttttttattttaagaagaaatgtaagaaggattgttgggtatttagtttttattaatatttaggtttattgatttaaaaataaaataaaataaattttgtagtttgttattttattattgatatatttttagtgaatgttatggttttttggttttaaaatttttttttttgattttttttttttttttgttttggttttttgtttgtattggttatagggttgttgtttttttttttttattatagtattttttagattgttgatgggttggggggagatagagaatagtagaaaaaagggaatagtatattaattttggagttttgagggtgagggggagaaaaaaagttttttataaagtatatttagttgggattcgaggggttgttgatttgagtgagggttgagtatacgtaggattatttttttttttttttgatttttttagatttttaagttttttattaaaggtattgtttttggttttaattttttgggttgtagttgttgattttttatttttagttaaaagtatattttcggtttagtagggtggtatatatttataattttagtattatgggaggtcgagataggtggattatttaaggttaggagttttaggttagtttgattaatatggtgaaattttatttttattaaaaatataaaaattagtcgggtatggtggtatatatttgtagttttagttgtttaggaggttgaggtaggagaattatttgaattcgggaagtagaggttgtagtgagttaagattatgttattgtattgtagtttgggcgatagagtaagattttgttttaataataataataataataaaagtatattttttttgttagtagtttatatgtgatacggaggattttagggttagtgttttgttgttatatgtttataaggatagggatattttttgtattattttatagttaatataatttttatggagggtggtattgtggatattatatattagaatttagagttaatgaggattatgtagagatgaggtttaaataatataagggatagatggttagttttttatcgttgcggtgattatgtgtttattatagttttagtgatttttggattttattttattaatttagtattaattttgttgatcgtttttattttaagaagtgagtgaaggtcgggcggggtggtttatagttgtaattttagtattttgggaggtcgaggtggatggatcgtaaggttaagagatcgagattattttggttaatatggtgaaattttgtttttattaaaaatataaaaaattagttgggcggggtgataggtgtttgtagttttagttatttaggaggttgaggtaggagaatcgtttgaattcgggaggtggagattgtagtgagttgagattacgttattgtattttagttcggtgatagagcgagatttcgttttaaaaaaaaaaaaaaaaaaaaatgtagtgagtgaaataaggtttagaaaggttaaataagtattataggtttttattattaaatatggttaattttaatatttaggttttttcgaatataatatggttaattttttttttttttttagaggaatgagggttttgttgaaggggaatttggaagttttaggagagtggtattttttgtggttttttcgggtaaagaaaagtaattaggaattaggatttgatgagagttagaaaaataattattttttattatatttagtttttatagtatatagtcgaaataatttatattcggaaagatgatatatttatttggttaattttggggagcgggttttttttttaggaaagtttgagtaaaaataaatataattttagtttatttttgagcggtataagtattaagaagatatattttagtggcggttatttttcgtatttattggaaaaagtcggttacgtttagttttgttatattttttataagttaagtttttgagttgtcgaggaggtagggttagagtagatttcggttaggggtgatgagattaatttttagatatttttattttaattttttttatttatatttttcgtatttgaacgagtaataggggaatgggggtgaagggggaggaagtggagaatttatttaagattagtaaaatagtagattatagggtatgtagttaaatgttgtcgttaatgataatagaaagttggattttttgattttatttatttgatttagaaattagaggataaaatgatgggtacgtggtttatgatagaagtaaggaaaaaaaaaataaattcgttatttattttttttgttatttattttattttttataagtaatttttaaaacgttttgttttatagatatgattttttttaagtttaagtgattttaagaggtagtaaagtattagggggtaaggatttaaatttgaatttagttttgttttttattatttatgtgattttagaaaagagatttgatatttgagttttagtattgttttatgtaaaagaaggatattattagttggatacggtggtttatatttgtaatttagtattttgggaggtcgaagtaggtcgattatttgaggtcgggagttcgagattattttgattaatacggtgaaagttcgtttttattaaaaatttaaaattagttaggtatggtggtgcgtgtttgtaattcgagttattcgggaggttgaggtaggagaattattttaattcgggatgtagaggttgcggtgagtagagattatattattgtattttagtttgggtaaggagagcgaaattttatatttaaaaaaaaaagaaggatattatttattttaaagggttgttgtaatgaaaatgtaatttatggaaagtgtttagtattgaattaaatatgttataagagtttaatgaatggttattttatagagaaggaaacggaagtcggagggaagttaatgttagtttgaagcggtatttagtttagtgtgagtagagatgggataagaatgagattttataggttgtaagattaagatttttatatttattttttttttttgtatttaaattaattttttttaaatgtatgtgtaggattagagaatgagaagggagatagagtaaggagattaatttttattaggaataaggtttagaatttgtagttgtttttgtggtttaagtagtttttagatttttttatttttttaagttgtagaaagggataggttgtttttatagggattattgtatgggaattcgaggatttgaaatttagtaatatggttagatgtagggtttaagagatttttattttattttttttttttttttttttattttattagttattttaagtaaaggagaatagattaaatagtcgaaaaaataaataggggtttaaaagtaaaaaataaagggaagggtttattaagaagttgcgtttatgagtgttttttggtgttttttggaaagattttaggtttttttattatattttaaaaaatttgttttttttttcgttagaattttagaagaagtgttttggtttttttataaattgttaagataggggagttaggtttttaatttgggagtagttagggtgtgaaggaggggtgtgagggttttaagttttatattaggtgcggggttggagcggggtttatttgtgttgttttatagtttcgttattaggaagttcgattttatatacgttgtattgtttttcgatggttcggttttttgattttatgtttatagttagtttttttagtttgttgaatagttttttttggatgaagttttggggtagtagttttttataggtgttgaagtttatggagatagttagggtaggttgtacgtggaggttagaggttacggaagacggtatgtttaatatagcgttagttttgtggttgggtaatacggagtagatgtttagatgttttttaggcgggggtgttgggtgtttaggtcggttagtgggggtttggttagttttagttgggggtggtatttgttcggtatttttttttcgtttatagtgtagttttttagtattggtgatgacgttgtttcgagtcggggttttaggtttttttttgtttttttttttaattttgttttttattttttttgagatgttggattcggttgttttagggttgttttggttgggtattttatttatttgtattattttcgtttttattttagttattttagggtgtcgtttatttttagttagagttggtttttcgggttttgtaggtggttgaagagttttttgtaggagagattgttttatggttattaaattgtttattgtagttttggtgggatttatggttgaaagattaaatgaagtggagattgaagggttttggtttattatgggtttagggaggttttgtttagttatattggtatatttatttttttcgttggaatgtttcgagatgaagatgtttttgaggtatcgagttttgcggtttttttttttttcggtttcgttatcggttatggtggttttcgtgttattgtcgtttgaggtttggatggtttttagtatttttaggtattgtttttttaggtattcgatttttaggatttcggtcgtatatagtaggttatttaggtttttcgttttggtttgtagcgtggttgtatatgtatattttagaatttgttggaaggtttttggcgagaggaagtttaaagtatagtgttgattattgcggtggaagaggattttaaatattttgttggtgtaggttagtatcgttcggtgggcgtggaatttttggttgtttattatgatgattatatcgtataaagtttcggttagtcgtatttggttggttttgtatagtagtttcgtggggtggttagggttttgtagttggattatgtttatttttgttagatttatggtgtttttttcggtttaggtatgaggttttttttttttttgggttttgcgtggcggggttgggtgggttttttgggttaatagaggaggttaggagaaagaagaggggaagaagtaaaagagatgagagaataaaagataaatttattagtgtttttaaaagtaagaatttaattattataatatgtttttttttttttgttgttaagtttttagtaagaggattttagagattttaattgaagtagttttttagaaatttataaatttgttttttaagttagggatgttgagagtaaaaagaaggttttgttatagtagatgtttaatttattattttatgatatttgttagatgaagtgaaatgaaaattgtagtgaagttttataagtttttagttttttttgtgtttgagagtaggggttttttaggtaaggttaatatttattatgatgaagtgtatttatttaaaattagtaagattttagttttttttttgttagttttacgttagttttttggatgttaagttttatttttaaatagtttttttaaattttgttttattataggagttttagaagtagagttaaatttattggaggttaggagtttgtagttatggttatagaaatttatggatattgggttttttttcgtaaaggttatttttttattattagttttggtttttggttttttattgtttttagggttgtaaagtattggtagatttaaggtttgtttttatttttaggtattaataggaatatatataatttatatattaatttgggttatttttatttacggaagttttaaagttattgtatgtataatataaaatttgaattgtgtgtatgtatattagttagagatagatagaaagagtgtgtggggtagggcgcggtggtttacgtttttaattttagtattttgggaggtttaggtaggcggattatttgaggtcgggagttcgagattagtttgattaatatggagaagtttcgtttttataaaaaatataaaattagttaggcgcggtggtattcgtttgtaattttagttattcgggaggttgaggtaggagaattatttgaaatcgggaggcggaggttgtcgtgagtcgagattgtgttattgtattttagtttgggtaataggagtaaaatttcgttttagaaaaaaaaaaaaaagtgtgtgtgtgtttatatatatatatttacgtaaggtgtcgtatttatttttttgtttataattgttcggtggataggaggatttaaaaaacgaagaaggatgggttattaaggtatggagagagattatagttaaatatggttttttatagttaggagtgtttatgttgggttgggtgtgtgaattttacgtgtgttttataggttttaaggagtttgtaagttttgtgattaggggtagtaagggatgttggatatggtttagaggcgttggaagtgatattggtattagtatttgtggtgtgagttataattagtacgaagggaagatagggttgggaaataaaggttttttttagagtttgttcgggattaataagagggtttttagattttaaatttcgtttataggagtgttagaaagatcgcgtaggtttaggatttttttcgtgtttgttttatagcgattaatattgtagtgaatgtattgagagtaaggaatagtaaggttttttttttatttttcgaatattgtttgtttgtttttatttttagaaggagttttattagtttaggagttattaagtttacgtagaaaggatttataggacggttggttaagatatttttgttgttcgtttcggggtggggacggaggtcgttaaggttgggatgagtatttagtcgagtcgagttatcgcgtgttttttcgtagatatcggggtttttgagaattaggagggaatagttaaaagaatggaagtttggcgttttgaaataagttttttgggttttgagggaaatttgggcgtttacgggtagtcgttttttttattcgtcgttcggcgttcgcgattcggttggcgttggttgtagcgtttagttaggcggcgcggggaagagtcggcgataattcgttcgagtttcggggatcgatcgcgtttttatatttttttagtttttagcgatttttatcgagatttggagacgattttagtaaatttggggaagtaatttttttcgaggagttagatttttgaaagaaggagagttgagttagggacgagggaaagcgaaagagacggggaggaacggcgatagttcgggcgggttggatttcgcggcgagagcggtaggggaggcggattcgtttcgcggcgaaggggaagtataaaagtttcgtagcgagttgtgggaggaaaggcgagaaggggtttgttcgtttttttttttcgatttagggtcgtgattttttgggagcgatcggttgggttttaggtttttggttagcggcgttagcggttagcgcgttcggtttaagtacggtgcgagcgtttcggggaggcggcgagcgagtcggtgcggagcgtttcgtgcgttcgggtggtttcgcgggtcggcgggatcgtgcgtattttaagcgcgtgcgggagtgtgcgaggcgttgtgcgagttagcggcgggcgcgttagggtgggaaaggtatttcgaacgtattaggtgtagagatcggtatttatcgagagcggtcgggagcgtacggcgagtttcggtgttatcgtcggtttcgtcgagagtcgaggagggttcgtagcgttgtagattttttggagttttttttttttttttgtaaaaggggggtggggattaagtttaattaagaaaaagtttattacgtttttttaaagagaaataaaacgtaagtagttttagttttgttttttttcgtttttagatttattcgttagttttttcgattttagttttttagtcggtcggcgaataaatatataaataaataaattataattttattttgcgttcgcgtatcggttcgtatatataagagtatttacgggttttgttgtttcgttagtttttggcggtataaagttttcggattttcgatttttttgtttacgtttttagttttcgtatatcgttacgttttttattttttatttcgatcgtgttttgaagaggaagggttggggaggtagttgcgtttaggttgatagtcggggtttttttttttagtcgatttttaatcggtggcggcgacggttgtagcggtaggaagggaatacgttaaataaaaaaggtataagtttagcggtcgagtggtcgaagcgagcgcgcgttttttagatttttttagtttcgggaagtttcggcgcgcggcgttcgttgggcggtgcgttttttttcggttttttatttatcgtagtcgagtcgggtattgtggggtgggtgtgcgtgtttgtcggggggtgtgtgtttgtgtcggggaggggtgttgttggggaattgttgtttttcgtattacggcggtagcgatagtatcgttcggtagttcgtagtattcgtttttatcgtttttaatttttttttgttgcgaggttagtaaattattatcggttgttgcgttttcgtcgcgttttacgttaacgtcgagtttttttttttgtaaggtttcggcgtttttttatttttagtgttggcggtcgagttcggttttttgtttatagttgtttttttttttttttttttttcgcgtcgttttcgggtttagttcgtttattatttcgtattggtcgagttcgcgcgcgtttttcgttttattttttttttttttttttttttttttttttttttttttcgcgtttcgcgtttcgggtttcgtttgatatttagttgttgttggggcgtcggcggtcgttttttatcggtcgagcggagaggaaggaaggagttagaggataggagtgtatggggatttagaatttttaataggggaattgagggtgaagggcgcgtagtagtttttatttatttttaagattttaatttgtattggatacgggttttgttttttttttttcgtatttcggtgtttaagtacgtagttttgtttttttttttaatgtttgttttaatttagtgcgtgttatttcgtttttaattttttttttatggttcggggttgtagtttttttgatatttgttttaaaaggtcgtttttttagtttaaattcggtttttttatttttttggttattgcgcgtttttcggtttgagtattcggattttaataagtttttcgaggtagagttcgcgggcgttagtgaattaggtgttagaaggttcgcggggatttattgtcgaagcgagatattcgtttttagttgtcgcgattgttggaggttaaggtcgagttttgggagaaattttttttttttttaaattttggatagtttttcggttttgtttttattttattttttcgttttttagtaatttgggtggaaatagttttcgagaattgcgtttagtttagtgtatagtttttagggggtagggggaagtttggataatttttgggttttttaaaagtgtgtttttttttagttggtcgttttattttagagggtagagtagttaaagaaaatgtattttttttttgattgtagaaagttgttttttttttttttttttggagttgagcgaaggtagggtgttagaggcgggaagcgtttttcgggtacgggttgtggattttgatcgaagtttaggaggttggggtgggaggtgggggtggtcgagagcgttatttagggtttttaggttagttagttttcgaggttacgcggttttagtaatgcggagtttatgttattaaggtttgagtttgtatgttttgttcgtgatttacgggtgggttagaggtttttcgtaggatttatttagaattatatttttatgcgtgtttttggtattgttttagatttagttttatgaattgtagggttatggaaggtggtagaaatttgtatttgttcgttgaaggttaggcggtagagtttatatatcggaattgattcgggtttataagagtcgtttatgaggtagttttaaagacgggttattttattttagtaagagttatttttgatttttaagagtagggaaagtttagtttagtaggagtttgcggagagagttgggtaggggaatatatttgagtgaaggaagggtttttttgatagtacgggatataattatattaaatttagggtaagcggaggggaagttt

SEQ ID NO: 61 - DNA, 18012 bp, Artificial Sequence
  chemically treated genomic DNA (Homo sapiens)
gtggttttatagttgttttaggttttaagtagaggttaaagtattaaaaaaaattgaagaagatatatttaaatatataggtaagtataaaattttgttttaaatatttaatttaaaaaaaaaaattagaattttatttttttataggaaaggatagtttaaaatgagtatgtttaatttatagttttgaatgtggtttaatataaatttataaattgttttaaaatattatgagatttttttgtaattttttttttttaagtttattagttgttgatagtgttattgtgttttttgttgttgttgttttgagatagagtttttttttgttgtttaggttggagtgtagtgttgtgattttagtttattgtagtttttattttttgggtttaagtgatttttttgttttaattttttgagtagttgggattataggtgtttattattatgtttgtttattgtttttttgtatttttagtagagatggggttttattatgttggttaggttgtttttgaatttttgattttaaatgatttgtttattttagttttttaaagtgttgggaatataggtgtgagttattgtgtttgattagtgtattttatatgtggtttaagataatttttttagtgttgtttagggaagttaaaatattggatatttttggaaaatattgtatattttgaaattgaagttttaattgattaggatatgttaagaatttagaaaaataaagtttttatgtatagttttttttaaattttttgttaattgggtaaaatggttgttagaggtgattgtgttttttttttgttttgttaatattatagaatttataaatttttttataaagagtatgatttagtttttttttttttgtaattatattttttagttgaaaaagtttttggttattatatttagttataaattagtaatagtgtgtatatgatttttgattatttttttttttgagttagaattagaaattggttttgtaatatttgtggattttgttttaattatatatttttttttatttgaaatatttagtatttttattgtttatatggtgaattttgagttttttaatttaatatataatattgaaatttttgttttgaaaaatttttaaatatttttgaagtttagttttgttattattttttttttgaaattttttttgattatttagttggaaatgatttaattttttattttttaatagtatatttttttgtattaaaattttttttgtaaatgttttagtttttttttagattataaattgttttatttattattgtattatttatatttatatattgaataaaaagtattaagtattgttatagatgtgagggaaagagtagtgtaggagaattttggtttttgtttttatgggatttatattttattttggaaaataatgatgagagagatagaaaattaaataaatatatagatagagttttttagattttaaatgtttagaatgtgaaattttattatgtggtagaaagtgtgaggatagtattagtgtgttgataaggtgattatggaaggtgtgatttttgaaaatttgatatttttgttaaaatttgaatgatatgaaggattagttatttgaagatttggaagtagaatttttgaggttgaatgaaaggtagttttaaggtataagaaagaggtaggtgaggaaggataggagaagtgataagaattagatttagattatgtagagttgtaaattaaggtaaagaatttaaaatttattttgattatattgggaagttaatgaatagtttgaagtttttaagggtttatgttattatattgggtttatttaggataattttatgattttaaggttagttaattaataaatttaattttatttgttaagttttttttattatataatgtagtatatttattagagtaatattagagggtaagtttttagggtttaaatgttgttatattttgtatgtataagttttatttaatttaatatatatttagtattttataagggtagtgaaatagaattaatttagggtagttgagttgttgagttattatagtttttttgatttattttgtttttattaatatgtttattttttggtattattttttatttgttaatgtttatatgataattttaaattttgtttttttttagttatttaattaaattaatataaagatgttttttgtatttaaagaaattttgttttagatattttttagagagatttgtatttttttatggataaaaatttatgggtggatttattgtagattttaaaaggatatttttaaatttgtttgagtttttttatttttatttattttgattataataaatttatttatttaataaatatttattaagtatttattgttgtagagttagttattatatagtaagtattagaatgataatagttgaataagtaattttttatgagggatgaggtttgaaaaagtataagttgttttgaaaggtattttagtgaaggaaattgttgttgagatatggaggatgaggtaatatagttagtattggttttgaaggtggattgttattttattgttgggtgaatttggatattttttaaaatttttttgagttttaattttttatgtatgtgaatagtgatatttttatttttatagaagttttgttagattgaatatatgaaaatgtttaatgtaatgtttgttattggtttagaagtatatttattatgaaattgatgaagtttagtgaatttaattgtatggttttttttaaggtttttgtaggagtagttttagtaattttgaattaatttgtgttttttttaaggatttttttatttagttgtttttttattataggttgttggttattataaaatttgaatttgtttttggttataggttaagtgagaaatgttaattttttttttttttaatgttgtgattttagttagtgttgaatttagaagtatttaatttaaaaaaaatggaaagaaattatatatattaggttgtaggaattttataaaatttagaaaaattgaaatttttgtaatttttagggaggaaatatgatgttttatttttttttgtttttttttgtgtatatatgtaatttattttttaaaagttagtttatattatattaaatagataatattttgtatttttatataatatatggattatataattatatattatataattatattttataatgtaattttaattattttataaatgtgttaaaagtataattaattaagttgttgttagtaattgttgaggttttttttaatattttagtagtataagtaatgttaaattataaatttttgtaggggtatttgtatataggataattttttttaattgggtttgtttgagtataagaattgtttttgtttattttttgttattataataaaatatttgagattgggtaatttataatgaatagaaatttattggtttatagttataggagttgagatgtttaagagtatggtattagtatttggtgagggtttttttattgtgttattttaaggtggaaggaggaaggataggagatggttagagtaagtaagggattaaatttgtagttttaggttttttaataaaatatattaatttattattgagggtggaatgtgaatattttttattaggttgtagtttttaatattgttgtattggggattaaatttttgatataggtttttgggggatatatttaaattgtggtaaatattttaaagatttatatgtttttattgattttataatattattttaaaatattattgtttatttttatagtatttttgtgtttatttttatttttttgattatttgatatattaaaatatttttttgggtttttttggttttgttttgttttgttttagatagagttttgttttgttgtttaggttgtagtgtagtggtgtgatttttgtttattgtagtttttgttttttgggtttaagtgatttttgtgttttagtattttgagtatttgggattataggtatgtgttattttgtttggttaagttttgtatttttagtagagatagggttttgttatgttggttaggttggttttaaatttttggttttaagtgatttgtttattttggttttttaaagtgttggggttataggtatgagttattgtatatgattagaatatttttttatgtatttattagttttttatatttttttttatgttaattgttagtatttatgtaagatattgggaaagttttttgataggaagaagtaagttttttttttttgtaagtaagttttgaggttgtataatattttaaattaaaaggttattttaaaatggtttttttattgtagtgtagtgggaattttgagagtagaatttaaaggagtgtttggtgttttttatttttggtagtatatattaaagtttgggtattatttatagatttttttttggtgttttaaaagttttttggagtattaaagggattttgtagtgtaataattaagtttagaaatttagttttgtggttgtattataatatttgtttttttatatataggggttagagttttaatttagaatattttgtttttttagtagaaggttatattttataataatattatttaataattgttttattattattttgtgagggtattttaattgaatgttttttgtgggttaatttaaaattattttttaaaataatgtttaatgaatatttatgtagaaaatattgtgatatatattatgagatatgagataaaattaggtgagggttttttttttgggattttaatagttaggaatgggataagaggtgtatatatataggtataaaatgtgtttgtgttataaaagatgtaggaataatgaagggaaaaggagatgaattgattttaggtgggttgttggattattttatgggaatttatgtttaagttaaattatgatttgggttagtagagtaattaattattttttattttaaaaaattgttttagtttataaagtttgtttataatatataatgatttttattatagttttgtaagataagttagttatttttattttatagatgaaggagtagttaagttttagaaaagttaaatgatttttttagtgttattaagttataaagtgaaagatttagaatttgaatttaagtttttaatttttatatgttggagttttttaaagtattttagtagagtagtgaagagttatatgagtaagaaattataagttttagaaagggttgatagttaattttattattaggatggaagttttgaaatagttggagataaagttatagtatggttagtagaataatggttttttataaatgtttgttttttagtttttagaatttatgaatatgttaggttatgtgataaaagggaattaaaatggttaatgaggtaattttaaaataggaagattattttggattattgatgtgggttaaatgtaagggtttttaaagaggttatttaagagtggaagagggaggtagaaaaatgagagttagagaaggagatttgagaaggggtaaggttagttttgtagaatgagaaagatttagtttattattgtttgttttgaagatggaagtgaagtgttatgaattataaaatatagtggatttgtagaagttagaaaggataaggaaatagatttttttttagagtttttagaaagaagtgtagttttgtagatattttggttttagtttagtgagatttattttagatttttgatttataaaattgtaagttattaaatgtgtgttttaagatattaaatttgtggtaatttgttttggtagttataggatatttaatatgtttaggaattattttattgtaggaagattaattaatatgattttagggtattttatgattaaattttaaattgtttttgttttattgttagtagtagaaagatatggaatgtttttgagtaaaagtgtgaagaattattttggtgtttgttgattagagaggatattggtgagaggaaaattaattaagattttattagatgttaggaatattttttttgagatttattttttgaggtaatatagaatatattggtaagttttgtttgtagaagattatgaatatattttttagttttgtgtggttgtttatgtttgtaattatagtattttgtgaggttaaggtaggaggattatttgaggttaggagtttgaggttatagggagttgtgtttatgttattgtattttagtttgggtgatagagtaagattttgtttttgaaaaaatgggagatggttaggtggatggatagatagatagatatatagataaagatagatatgtgggttaagattttttatttagtttatatattattgaaaattttattgttattgtaatattttattttgtttttgtattttatgaaaaatatagaattagttaggtatatatttaatttatttttttttaggtttttttattgtattataattaattataagatttgaatattgaaaggtttttaaatttgagttttatttgatgttttagtatttgtagaagttaaatttatattagtaattgtttttttaatgtataattattattttgaaagaaaaaaaaagtttgttgatatttgtaggtataattttattttatgtttaaggtttttggtaaagagagatgattaagtttattagtaaagtattagagttaattaaggtgattgaaaggagtattaattttaatttattttatattagttaatattgttaatattttttttgttagttttttaaattaaaagttttaaattaggttaaaagtgtttaggtaaaaatggaatggaaagggtttttttgtgtgtgtgtgtgtgtttttttttttttttgagatagagttttgttttgttattgaggttggagtatagtggtgtgattttggtttattgtagtttttattttttaggtttaagagatttttatgttttagttttttaagtagttggggaatgtaatatttaagatattaagaattttattaattttatttagttatttttttttgtagttgtagaaggtttagaagggttttttaagttgaattatatgtttatatttataatatttatatatgaaattatttattaaaagtaatgaagttggttataataaatattgatattgaaaataagagatatgtttgttagtgtggtttttaaatagtgttatataatttatttttgttttattttgattagaaaaaatatatatattttttgagatatggtttttgttgtataggttggagtataatggtgagattttggtttattgtaatttttgttttttgggtttaagtgatttttttattttagtttttagagtagttaggattataggtgtgtgttattatagttggttaatttttttgtatttttggtagaaatgaggttttgttatgttgtttatgttggtttttaatttttgagtttaagtgaattggttattttggttttttaaatttttgggattataggtatgagttattgtattttgtttagaaaatatttttaatgtatatatatatatatatatatatgtatatgtagtgtaaataatatttttaattaaatagagatggtaggagttttattttgagttatgtgtaaatttgataagataaggtaatgttttagtaattttttatgttgaaatttggtttagtatattttgattatatatttatatttaattatagttttaaaatagttaagtagttttaaaaatttaaattaaatttttgtggaatttttaaaaataagaaaaatattattgagtaattggtaatataaaatataaaatgtttaatttggtttttttttagatttgaagtatagtgattaatgaatatataatggttgtagttttttttataattatgttatttaagttattgatgaatatttatgatatatgtagtaaaaatttagataaatattttggttataaattggtttattaaataatagtttgtattatagtttgagttaagagtaataggtttataattgtgttttagggtattaagaagtttttttgaggattttttaaaaggtattttttgttttgaaagattgttttttttttggaagttttaggttttatgagaaattatttattttgaatttgttataaaaaatgatttgtaaataagttttgtgtagtgaattatgtgtttttagtaagaggattttgaaagttttttgtaaaatgaagttatttttaaaagagagttatttagaatataattaaattgatttatatgtttttatttattttaaatatgaagggaaattgtttttaaatatatttaaatttttaatagaatagtagtatgttattagtgtggaaataatttatttgttaaataaatatttggggtgtatttgttgtatattaggtattgtaatatagggattaatgaaagagaaaaaaaataaagtatgaaaggatagtagaaatagttttataattttattttttaggaataatttttatggatattttgttgtgtgtttattgtttttttaatatatatattttttaattaaatggaattgttttaaatatgttatttaatagtttgtttttttttatattatttgaaaattaagaaatgattataatatgttttatttaaaaattttaagtttaggttgggtatagtggtttatgtatgtaattttagtatttggagggattgaggtgggtggattataaggttaggagattgagattattttggttagtatggtgaaattttgtttttattaaaaatataaaatttagttgggtatgatggtatgtgtttgtagttttagttatttgggaggttgaggtaggagaattgtttgaatttgggaggtggaggttgtagtgagtggagattgtattattgtatttgtttggtgatagagtaagattttattttaaaaaataaataaagaaaatttgaagtatagtatttttttaaattttaaatagataatagaaattggtttttttttatttaaattagaatttaagtttaattttatatatttttgatagtttggattttgttttttaattttataaaattgggaatttaagtattatttggtttgatttaaatgtaatgtagaatttgtattaaaatattatattaaagttttagatttgtagtagttaatagtatttttatgtatgtgttagggattgttttaaatattttatatatattaatttttttattttgtatttttgtttttgttttatatagtaggaaattgaaatattgagaggttaagtaattaaagttatagagttagagtgataggagtaaagttttaatttaggtaatttagatttttagagttttgatttttattattaagttgttagtatagtttttttggtaattatttttaatttaaatataatttgagtgatttatttaataagttattattttgataatttagtgatttgtaatgtaaaattatttattgtaatttatttaatattattgtttttttgtgttgtaaaaattatagtaattgagatgtaatttattatttttttttttatttttggtattttgtgttaatttttttgttttgtggattttttttgattttttattatgtgtgttaattgttattaatttttttgtttgttggggattggggttgtgagggtatatttttgaggggtatggggttagggttaggtaggttgtgtggttgggtggggttttgtgttttattgtggagtgtgggttgggaagtggagagagaagtagttgtgtaatttgttggatgtggattagggtgttttttatttttgttgggagtttgttgattggttgggtgtgggtgtatgtgattgatatgtggttgtattggtgtagtttgttagggtgttattggagatagaatggaggtgttgttggatttggaaatggggtaggtgttggagttattatggttaggtttgttgtggggggaggggggaaggtggtttttttttgtattgttttaaattgatggtttttttttggtatagggtttattgtagtatgttaaatgaggaggtaggggtgttgtttttttgttttttattgtagtattggagatggattttttgtattttggatttagggtttttgatagaagaggaagaagggggaggggtagaagtgttaaggggagtttgttgagaaaagttgtttttgaagttagaaggggtttttgtttttataatgttatttgatagagtggaataatagtatttaaggaaatgggtagaggataataaagaatggagtatatttatggtgaggagtaaaagttttattttattgaaaggtttttttttttttttggtgataaggatatatgtattggtggttaaaagagagaggagataaaattgttgtagatggttgatgtgaatttagtggaaagagttattggggatgagagaaagaggaggaggtaggtattgtagagtgtgagtggtggtgttggttggtgaaatattggttattagtagtgtgtttgtttttgtaaaatatttaagtaaattttttgtgaatagggtggtaaatagatattagtgtttttgttagttataaaatgtagtggtagtggttttttgtggatgattgtagtagtgttttttttttttttgttaggttgaaaagataattgtagaggaataagaaattttgtagtaaatgttggggtagaagtttatttataagaagttatagtttataaatgtagtttgaatagtagaaaaaaaattattgttttttaaagtaggaataatgttaggttatgaatgttttgttattggaatgtattggatattttgattttatattatgaaagtgatgtttaaattttttgatttaatataaattttatatgaaattttaataaattatgtatgaaatagtggatttttttttttgttagtgaagtttttatgttattaattaggttatttaagagtaaattattttataatgtaaattattttgttaaaaattatggtgaataaatttttgtaggtttaatatttaagatttatagttaagtaattttatatttttttttggttgtttttagataatattgaataaatatttaagatattaatttagtgtgtaaatattttaaattaaagtaatatggttttttttttagatgtatttttgtttagtgagtatttatgagatatatttttgatataaagtgttttttattgagttttttttttttttatttaaatgtaaaagtttatttttatgtatatttatagtagttagtttgttatatttttttattttttgaataaggatggtagtggttttgtaaagttttttagggttagtgatagtgttttttaaataatgtttatgtaatagaaagttttaagatgatttattatattgttttagtaatatttttaagataatgtggaattgggttggtttagataaataagattatataagttttttattgataaatttaaatagttttttaaaaaattatttttgttttaagaattatttgattatggatattagggttaatagtatttaggagttgggtgtggtggtttatgtttgtaatataagttaaataggaggttgagggaagttgaggtaggaggattatttgagttttggtgtttaagattagtttgggtaattaagtaagattttattttaaaaaaaagtatttagagttttttttttaaaatttgatggaaattatggttagaattaaagatgttatattaaaattttaaatgatatttaatagttaatattatttagttttttgaattttattagtatagtgtttgagagtttataaaattattatttttatataaattattttttattattttaatagtttattgtagtattatttttattttaaatgttagagatttttatttaagtatgttgtgattttatttaaggttaaatattgtataataatgtaaagaatttaagttttttattttattttaattttataaaattataatgttttttattatatatatataaaataatatataatagaggtaatttgaaaaatagtgtaagttattgataaattatttaaaaaatgaaaaggtaattttatttggttgtggatttttatttataatataagaatgttttaaaaaatatttggtgattaagtaaatggagaagtagtagtttttataatgatatttataaatgattttttaaagattgttttattaattatatgaatatatttaagtagaatagtgttagattgagatgtttttttgaattaaataagaaataaagaattaaagtttattttattttttttgtagtatatttaatttatgattgatttattggttttagtggtttttgaaattatttattgttttgatatggtttgaattgtgttgtttaaggaatttaaaattaaatatttataaatgttttatgaattgaatttaagttattgaagtttttgttttttgtgtttttttttttttttttttttttttttttgagatagggttttattttgttaatttaggttggtgtgtagtagtaaatatggtttatttgtagttttaattttgtaggtttaagtgatgtttttattttagttttttaggtagtagggattataggtatatattattgtgtatagttaatttttatattttttgtagagatggggttttattatgttgtttagggtggttttgaatttgtgagtttaaatgatttttttattttagttttttaaagtgttgggatttataggtgtgagttattatgaagtttttttatttgtattaattgttttgtagattttattatttttgtttgttttataaattgttatttattttatgaaatttaattaattttttatatttgtatatgtttaaatgattttttatatttgtatatgtttaaatgttttttttaattttgattttttttttttttttttttttgtattagaatttgaaatttatttatgtagtatataaaatgggatagagtattatggtttagaaaagatgggtaatagtttaggaaatatatttattatatatttattaggatattttttaaatattatttttgaaaaatgttggagttaaataagatatgtaaattaatttttaagaaaatttatggtagaattatgtgaaattttattataagttaaatattgttttggttatttttaggatatttaaagatttatataatttaagatattttttaatttagaagaatatggtggattgttgtttgaaatattgtttttttataaaatttgtttagagttatagagaatttttgaaaattaaattatttttgaagtattaagtattttgaatgtataatgagaatattaggtgaataggtatgtttttaaaagttgattttgtaaattaaattatatattattagttgatataaggtaagtttttttttttttatttttatattttgtatttattttttttgtgtgtttaatatgtataaatttttgagaaatagtattattttgtgagtttgttttttatagttaatgagatttttaaaaaaattttattgtgataaatatatataaaatttattattttaagtatttttaattgtatagttttgtggtattaagtttatttatattgttgtgtaattattattattatttatttttagaaatttttaattttttttaattaaaattttgtgtatattaaatattaatatgttatttttttttttttttaatttttggtaattattattttattttttgttttaaagaatttgattattttgggaatttttaataagaaaaattatttaatatttatttttttgtatttggtttattttatttagtataatgttttgaaggtttatttatattgtagttatgtgttagaattttttttttttttaggtttaaatgatgttttattgtatgtatatgttatattttgtttatttatttgttagtggatattttaggttgtttttattttttgtttattatgaataatgttattatgaatgtgggtgtgtaagtgtttgtttgggttttattttttttgtgtgtatttaaatttgtgtttttaatttatataatttttgaatattattaatttaatattgtttttaagatttatttattttattttatgtttatttagtttgtgatgttaattttgttttatagtattttatagtatttattattgtttttttagtgaaggttgtaagttttttttaaattttgttaattataaatatttttatgatatatatttttatatatatttttttggattatgttatttatgtatttttgtataataaattgtattaaaatttagtggtttaaatagtttttgtggggtaagaatttaggaatgttttagttggatggtttgattgaggtaggattttttatgaagtagtagttatgatgttagttatagatatagttatttgaagggtttgattagattgatggatttttttttaagatggttaatttatatagttttagttttttattggttattggtaagagattttagttttttgttatgtgggtttttttatggggttgtttgaatgtttttatgatatagtagttggttttttttaatgattttaatagaaaggttatttatgatttagatttagaagttatatattattgtttttgttgtattttttttattagatatgagttattaagtttagtttattaaagagaggaattaggatttattttttaaaggagtagggttaaagaatttatgatatattttaagattattatattgattagtgaaatagttttattggatttatttttaggagagggattattggataataagggtattgttttttattgttgttgtaataaattaatataaatttagtggtttaagagaatataaatgtattattttgtagttttggagattagatatggtttttattggattaaaattaagatattagtggttttgtgttttttttagagattttattgaagaatttatttttttgtttttttttagttttttgtattttttgttttatggtttttttttttatttttagtgttagtagtattttaaatttttttttgaatttgattttttgttgtttttgttatatatttttttttgatttttttgttttttttttaaaagaatttttgtgattatattgggtttatttagataatttaggaaaattagttttaagatttttaatttaattatatttgtaaagtttttttagttatataaggtaatatatttataagttttggggattaggatttggttatttttgtggggttatatataggtatatttatttggttttttattttttttaagttgaaggatttttttagttatttttatttttgtgaatgtgtgttatttttttttggtaattttagatttttatttattaagtttatttaaagtatagtataatatataatgattattaagatggtaagtagatatttattgtttaattagatttttgattttattattatttaatttatattagtgtattagttatttttgatatagtttgtaatagaaattgagaaatgttaaagtaatatagttttattaaatttttttttgtattttttagatttgttataatattagttttgtgggtgttttgttgaaatttgatttgttattgttttattagttattgaatttagggttattttaatttagtatgattttattttaaatttgatttatttatgaagattttgtttttaaataaggttatatttgatatgatattttttggtgtttttttgtttgttggtttttttttttttgttgtgtaggttagagtagtttttgggtttaagtagtttttttaattgagttttttaagtagttaggattataaatatgtgttattatagttgattaatttttaattttttttttataaggagagagttttattatattgtataggttggttttgaatttttgtttataagtgatttttttattttagttttttagagtgttgggattataggtgtgagttattgtgtttatatttgtaatatatttttttatgaaatatagtttaatttataatatttttttaatatttggtattttgtgaataataagatatttaaatatggtattttgtggataataaggtatattgttttattttttttatggaaaagttattttggatattttttgaatttgtgttttttttttttgttgtttgttttttgtggttgataatgtattttttttgtttatttttatgtgtatatttgttttttatatggttgttgttgagtaaagtattttgggaattataaaagttaagtattagatatagattttgtttttaagatatttatgttttagttgggaagataaaatattttaaggtaaaatggaataatttgagaagttaggttaaattgtatagtatttattgtttagttagtaggaagatttattattggttagagatattaggaaggttttgtgtaagaaattgagttgggttttaaaggatgaggatatattataatagtagaggaaaaaaggatgtggtatttagaaaggggaggaggtataaataaaaatataaaggtaagaaatagtttgtagaggaaagtgaggagagatttatttgaggaaggttattttggaatttaataggaaataagttttgaaggtagattattattagatataatagattgtgaatattagatagaagttatatagtttttgagagtatgagtattaaaaataagtatagatttgaattttggtataggtttttgatatgtgtttttagggaagttatttattgttttggagttttattttttttaatttaaaaatgagtaatatttattttataggtggttgtgaggattaaatgagttaatatatagaaagtatttatattatgtgagatattgtaagtattaaatagatattaggttttttgaattttatatattaaatatataaaaaataagggtatatataggatttaaataatatgttggttagttatagaattttatatatttttttttttaaaatatttttagtaaaatttttatgaaaattagttaaggtaaatttttaaaaatttttagatggtaataattttataagtaatagttttttattaatttaataagtaatgtattaatgataataaaaagatgatttaaaaagttttatatatttaataattgagatagatttttgaagtattttttagattaaagaggaaattaagatggaagttatgagttatttggaaataaagaggggaatattttatattaaaatttgtggaatgtagataaggttgtattaagagaaaaattgatgtttttaaaatttatattattaaggatgaaatgaataagtgaatgtttaagtaaagtaaggaaataaatgaattaatatttattttattattattattattattattattattttttgagatggagttttattttgttgttgaggttggagtgtagtgttgtaattttggtttatagtaatttttattttaagtgatttttttgttttagtgatttttttattttatattatagttgggattataggtgggtgttattatgtttagttaatttttgtattgttagtagagataggattttattatgttggttaggttggttttaaatttttgattttgatttgttttgtaaagtatggggattatatgtgtgagttattatgt

SEQ ID NO: 62 - DNA, 18012 bp, Artificial Sequence
  chemically treated genomic DNA (Homo sapiens)
gtgtggtggtttatgtgtgtaatttttatattttgtgaggtaggttaaggttaggagtttgagattagtttggttaatatggtgaaattttgtttttattaataatataaaaattagttgggtgtggtggtatttgtttgtagttttagttatggtgtggggtgggggggttgttaagataggagaattgtttgaggtggaggttgttgtgagttgagattgtaatattgtattttagttttggtgatagagtgagattttgttttaaaaaataataataataataataataataataaagtgaatattaatttatttatttttttattttatttaaatatttatttatttgttttatttttaataatataaattttaaggatattaattttttttttagtatagttttatttatattttataagttttagtatgaagtgtttttttttttatttttagataatttatgatttttattttgattttttttttgatttaggggatattttaaagatttgttttaattgttaggtatataaggttttttgagttatttttttattgttattgatatattgtttattagattaatggaagattattgtttataaaattgttattatttgaaaatttttaaaggtttgttttgattaatttttataaaaattttattaaaaatgttttaaaaggaaaagtatataaagttttataattgattagtatattatttaaattttatatatgtttttattttttatgtatttgatatgtgaaatttagaaagtttgatatttatttagtatttataatattttatgtaatgtaaatgttttttatatattaatttatttaatttttataattatttatgaggtaggtgttatttatttttgagttaagaaaaatggaattttaaaatagtagataatttttttaagaatatatattaagagtttatgttagaatttaaatttgtatttgtttttaatgtttatgtttttaaagattgtataatttttgtttggtgtttataatttattatatttgataatagtttatttttaaaatttattttttattaagttttaagataattttttttaagtaagtttttttttatttttttttataaattattttttatttttatatttttgtttatatttttttttttttttgaatattatattttttttttttttgttgttataatatatttttattttttaaggtttagtttagttttttatataaaatttttttgatgtttttagttaataatgaatttttttgttggttgaatagtaaatattatataatttggtttaattttttaaattattttattttattttggggtgttttgtttttttagttggagtataaatattttgaagataaggtttatatttaatatttagtttttgtaatttttaaaatgttttatttagtgatagttatataaaagataaatatatatgtaagaatgaatagaaagggtgtattattagttatagagggtagataatagaaagagagggtataagtttagagaatgtttaagatgatttttttataaaaaaagtaagataatatgttttgttatttataaggtattatatttaggtattttattatttataaggtattaagtattaagggagtgttatgggttgaattgtgttttataaaaagatatgttataggtgtgagtatagtggtttatatttgtaattttagtattttgggaggttgaggtgggaggattatttgtagataggagtttgagattagtttgtgtaatatagtgagattttttttttatgaaaaaaaaattaaaaattagttagttgtggtggtatatgtttgtaattttagttatttgggaggtttagttgggaggattgtttgagtttagaagttattttagtttgtgtaatagagggaaaaaaattaataaataaaaaaatattaaaaaatgttatgttaaatgtgattttatttgaggatagagtttttataaatggattaagtttgagatgaggttatattggattagagtggttttaagtttaatgattggtaagataatgatagattaagttttaataaagtgtttatagaattggtgttataatgagtttaaaagatataaagagaaatttaataaggttgtgttgttttaatgttttttagtttttattatagattatgttagaagtagttgatatattgatataaattaagtgatgataaaattaagaatttaattgaataatgaatatttgtttattattttggtgattattatatattatattatgttttaaataaatttggtaaatgaaaatttgaaattattaaaagaaagtaatatatatttgtaaaagtaaaaataattaaaaaaattttttagtttaaaaaaaatggagaattagatgagtatgtttgtgtatggttttataaagatggttaaattttagtttttaaaatttatgaatgtgttattttatgtggttaaaggaattttgtagatgtgattaagttaaagattttgaagttgatttttttggattatttgggtggatttaatgtaattataaaggtttttttaagaaggaggtagaagggttagagaagaatatgtgataagagtagtagagggttagatttagagagagatttagaatgttgttggtattgaagatggagaaagaggttatgagataaggaatgtaagaagttgaagaaaagtaagaaaatggattttttaatagaatttttagaggagatgtagagttattgatattttgattttggtttagtgaaaattgtgtttgatttttaggattgtaagataatatatttgtgtttttttaaattattaagtttgtgttaatttgttataatagtaataggaaataatgtttttattatttagtgattttttttttagggataaatttagtgaaattgttttattggttgatgtaatgattttaaaatatattataaattttttgattttatttttttaagaggtggattttaatttttttttttggtgggttggatttagtgatttatatttaataaagagaatatagtagaagtaatggtgtgtggtttttgagtttaggttataaatggtttttttgttagaattattgagggaagttagttgttatgttatgaagatatttaagtagttttatggagaggtttatgtgataaggaattgaggttttttgttaatagttaatgaaaaattgagattatgtgagttagttattttggaagaagatttgttagtttagttaagttttttagatgattgtatttgtgattgatattgtgattgttattttataagagattttgttttagttagattatttaattaagatatttttgaatttttgttttatagaaattgtttaagttattaagttttggtataatttgttatatagaaatatataaataatatagtttaaggagatatgtataagaatgtatattataaaggtgtttgtggttaatgggatttggagaaaatttatggtttttattggaggaatagtgataggtattatagaatattatagagtagagttagtattataaattagatggatataaagtaaaatggatagattttaaaaatagtattgagttaataatgtttaaaaattatgtaaattaaaaatataggtttgagtatatataaaaaaagtaaaatttaagtagatatttgtatatttatgtttatagtagtattatttatgatagataaaaggtggaaataatttgaagtgtttattgatagatgaatgaataaaatgtggtatatatatgtaatggaatattatttagatttaaaaaggaaagaaattttgatatatggttatagtatggatgaatttttgagatattatgttaagtgaaataagttaggtgtaaaagaataaatattaaatggttttttttattagaggtttttagaatagttaaattttttgagataaaaagtggagtggtggttgttaagggttggggggaggggaaaatggtatgttagtgtttaatgtgtatagagttttaattagggaagattaaaaatttttagagatgggtggtggtgatggttgtataataatgtgaatgaatttaatgttatagaattgtataattaaaagtgtttaagatggtaaattttatgtatatttattataataaaatttttttaaaaattttattaattgtaaaaaatagatttataaaatgatgttattttttaagaatttatgtatattaaatatataagaagagtgggtgtagggtgtgagaataaaggggagaaggtttattttgtattaattgatgatgtatgatttgatttataaagttaatttttgagaatatatttatttatttaatgtttttattgtatatttaagatatttagtattttaaaagtaatttagtttttaaaaattttttgtgattttaagtagattttatgaaaaagtagtgttttaaatagtaatttattatatttttttaaattagaggatattttagattatataaatttttaaatattttaggagtagttaaagtagtgtttaatttgtaatgaaattttatataattttattatgagtttttttagagattagtttatgtgttttatttgattttagtattttttaaagatgatatttagaaggtattttaataaatatgtagtgaatatattttttaaattattatttattttttttgaattataatattttattttattttatgtgttgtataggtaggttttagattttaatataagaaaagggggagaagggagattaaaattgaagagaatatttaaatatatataagtataaaagattatttaaatatatataagtataaaagattggttaaattttataaaatgagtaatagtttataaaatagataaaaatggtaaaatttatagagtaattaatgtaaatggaaaaattttatggtggtttatatttgtaaattttagtattttgggaggttgaggtgggaggattatttgagtttatgagtttgagattattttgggtaatatggtgaaattttatttttataaaaaatataaaaattagttgtgtatggtggtatgtgtttgtagtttttgttatttggagggttgaagtgggagtattatttgagtttgtgaggttgaagttgtaagtgagttatgtttgttattgtatgttagtttgggttgataaagtgagattttgttttaaaaaaaaaaaaaaaaaaagaaaaaaaaatataaaaaataaaaattttaatagtttaaatttagtttataaaatatttatgaatatttaattttaaattttttaaatagtataatttaggttatattagagtagtgaataattttaaagattattaaagttaataggttagttatagattagatatattataagaggaatgaaataaattttagttttttattttttatttaatttagaaaaatattttaatttaatattgttttatttaaatgtgtttatatgattaataagatgatttttaaaaagttgtttatgaatgttattatgaaaattgttgtttttttatttgtttagttattaggtattttttaaagtatttttatattgtagataaaaatttataattaagtaggattgtttttttattttttgaataatttgttagtgatttatattgttttttaaattatttttgttatatattattttgtatgtatgtaataaaaggtattatagttttatagaattagaataaaatagaagatttaagttttttatattgttatataatatttgattttggataaagttataatatatttgaataggagtttttaatatttaaaataaaaataatgttataatgagttgttaaaatggtaaaaggtaatttatgtaaaaataatagttttatagatttttaaatattatgttaatggaatttaaagaattgagtaatattagttgttaaatgttatttggaattttaatgtgatatttttagttttagttatagtttttattagattttaaaaaagagattttaagtatttttttttgagatagggttttgtttggttgtttaggttggttttgaatgttaaggtttaagtgatttttttgttttagttttttttagttttttgtttagtttgtattataggtatgggttattatgtttggtttttaagtattattaattttgatatttatgattaagtaatttttaaagtagaaataattttttaaagaattatttaaatttattagtgaaaaatttatgtagttttatttatttaagttagtttaattttgtattattttgaaaatattattgaaataatataataggttattttaagattttttattatataaatattatttaagagatattgttattgattttggagggttttataaagttattgttatttttgtttagggagtggggaggtgtggtaggttggttattataagtatgtataaagataggtttttatatttaggtaaaggaaaaaaaagtttaatgaaaaatattttatattaagagtatattttatgagtatttattaaatagaaatatatttagaagaaaagttatgttgttttaatttaaaatatttgtatattgaattaatattttaaatatttatttagtgttatttaaaagtaattaaagagaaatataaaattatttaattataggttttaaatattaggtttataaaaatttgtttattataatttttgataaagtaatttatgttgtaaagtggtttgtttttgaatgatttaattaatggtataaaagttttattaataaaagaaaagatttattgttttatatataatttattaagattttgtataggatttatgttaaattaaagaatttgagtattatttttgtgatgtagaattaaagtgtttaatatattttaatgataaaatatttatagtttgatattatttttattttaaaaaatagtaattttttttttgttgtttaggttgtatttataaattatggttttttgtaaatgggtttttattttagtatttgttgtaaggttttttatttttttgtagttgtttttttggtttaatagagggagaaaaagtattgttgtagttgtttgtaaaaagttattattattgtattttgtaattaataaagatattggtatttgtttgttattttgtttatagggagtttatttagatgttttataaaagtaggtatattattggtgattagtattttattaattaatattattatttatgttttgtagtatttgttttttttttttttttttatttttagtagttttttttattagatttatattagttatttgtagtggttttgtttttttttttttttggttattaatgtatgtgtttttgttgttagggaggaaaagaagttttttaatggggtagagtttttgttttttgttatgaatatgttttattttttgttgttttttatttgtttttttagatattgttattttattttgttaaatggtattataaaaataaaaattttttttggttttaaaaatagttttttttagtagattttttttaatatttttatttttttttttttttttttttttgttaaaaattttggatttgaagtataggaaatttatttttagtgttgtagtggggggtggggggatgatgtttttgtttttttgtttggtatgttgtagtggattttgtgttaaggaaaggttattggtttaagatagtgtgagggaaaattatttttttttttttttttgtagtaagtttggttatggtggttttagtatttattttatttttgagtttggtagtatttttattttgtttttagtgatattttggtgggttgtattaatatagttatatgttggttatgtgtgtttatatttagttaattggtgggtttttgatgggaatggggagtgttttggtttgtatttagtggattatatagttgtttttttttttgttttttgatttgtattttgtagtggggtatagggttttgtttaattgtatagtttgtttagttttagttttgtattttttgggggtatgtttttgtggttttagtttttagtaagtaaggaagttgatggtagttgatatgtatagtaaagagttgggggaggtttgtagggtagaaggattagtataagatgttggaggtgggagggagagtaataaattatattttgattgttatgatttttgtagtatagagaaataataatattaaatgaattataatgaataattttatattataagttattgagttgttagagtgatgatttgttagatagattatttgaattatatttgaattaaaaatagttattagaaaagttatgttagtagtttagtagtggagattagaattttggaagtttgggttgtttgagttgaagttttatttttgttattttagttttgtaattttagttatttaattttttagtgttttaattttttgttgtataaaatgggaatagaagtatagaatagaggagttaatatatatgaagtatttagagtagtttttgatatatatatagaagtgttgttagttattataaatttgaggttttaatgtagtattttaatgtaaattttatattgtatttaaattgaattaggtgatgtttaaatttttaattttatgaggttgaaggataaaatttaaattgttaagaatatataaagttaaatttaaattttggtttaaatggggggaaattagtttttattatttatttaaaatttaaaaggatattatattttaagttttttttgtttgttttttgagatagagttttgttttgttattaggtgagtgtagtggtgtaatttttgtttattgtaatttttattttttgggtttaagtgatttttttgttttagttttttaagtagttgggattataggtatgtgttattatgtttagttaagttttgtatttttagtagagatggggttttattatgttggttaggatggttttaattttttgattttgtgatttgtttattttggtttttttaagtattgggattatatgtgtgagttattgtgtttggtttaaatttaaagtttttaaatgaagtatattataattgttttttaatttttaaatagtatgaaaagaagtaagttattaaatagtatatttgaggtaattttatttgattaaaaaatgtatatattagaaaagtaatagatatataataaaatgtttatagaggttatttttggaaagtgagattatggagttatttttgttgtttttttgtgttttgtttttttttttttttattagtttttgtgttataatgtttgatatatagtaaatatattttaaatatttatttaataagtgagttatttttatattgatggtatattattgttttattaaaagtttaaatatatttagaaataatttttttttatatttgaaataaataaaagtatgtaaattaatttgattatattttaaataatttttttttgagaatgattttattttataaaaggtttttaaaatttttttattgaaagtatatgatttattgtataggatttatttataagttattttttgtgataaatttagaataggtaattttttataaggtttagaatttttagaaggaaaatagttttttaaaataaagaatattttttaaaaggtttttaaaagaattttttagtattttaagatataattgtaagtttattatttttgatttagattatgatataagttattatttagtaaattagtttgtagttaaaatgtttgtttaaatttttattgtatgtattatagatatttattagtgatttaaatgatatagttgtaaagaaagttatgattattatatgtttattagttattatgttttaaatttaaaagaaagttaagttaaatattttgtattttatgttgttaattatttagtaatattttttttatttttagagattttataaaagtttaatttgaatttttaaaattgtttagttattttaaaattataattaaatatagatatataattaaagtatattgggttaaattttagtatggaaaattattgaagtattattttgttttattaagtttgtatatagtttagaataaagtttttgttatttttatttgattgaagatgttatttatattatatatatatatatatatatatatatgtatgtattaaaaatattttttgggtagggtgtagtggtttatgtttataattttaggaatttgggaggttgaggtggttagtttatttgagtttaggagttggagattagtatgggtaatatggtgaaattttatttttattaagaatataaaaaaattagttagttgtggtgatatgtgtttgtggttttagttattttagaggttgaggtgggaggattatttgaatttaggaggtagaggttgtagtgagttgagattttgttattgtattttagtttgtgtaatagagattatgttttaaaagatatatatattttttttgattaaaatgaaatagaaataaattgtgtaatattgtttaaagattgtattgataaatatattttttatttttagtattagtgtttgttataattagttttattgtttttagtaaatggttttatatgtaaatgttgtaaatatgaatatataatttaatttaaaaaatttttttgaattttttgtagttataaaaaaaaatgattaaataggattaataggatttttaatgttttaaatattatattttttagttatttgggaggttgaggtatgagaattttttggatttgggaggtgggggttgtagtgagttgagattatattattgtattttagttttagtgataaagtaagattttattttaaaaaaaaaaaaaaatatatatatatatataagaaaattttttttattttatttttatttaggtatttttggtttaatttaagatttttggtttaaaaaattgataagaagaatattgataatattaattagtgtaaaatgaattaaaattagtgttttttttagttgttttaattgattttggtgttttattgataaatttaattgtttttttttattgaagattttagatatagaatagagttatgtttatagatattaataagtttttttttttttttaaaataataattatgtattgaaaaaatagttattagtataaatttaatttttataggtattaaggtattaaataaagtttagatttagaaattttttagtgtttggattttatagttagttatggtatgatggaaaagtttaagaagagataagttagatgtgtgtttaattggttttgtattttttatgggatatgagaatgaggtgaaatgttataatggtaatgagatttttagtgatgtataaattaagtgggagattttgatttatgtgtttatttttatttatatgtttgtttgtttatttatttatttaattattttttatttttttagggatgaggttttgttttgttatttaggttggagtgtagtggtataagtatagttttttgtaattttgaatttttaattttaggtgatttttttgttttggttttgtaaggtgttgtgattatagatgtgagtagttatataggattgggagatatatttatagttttttatgggtaagatttattagtatgttttatgttattttaaggagtgagttttaaaagaagtgtttttagtatttaatagaattttaattaattttttttttattaatattttttttaattagtaaatattaaaatagttttttatatttttgtttaagaatattttatgtttttttattgttgatagtggaatagagatagtttggagtttagttatggagtgttttgaggttatgttaattagtttttttataataaaatagtttttaggtgtattaaatgttttatggttgttaaaataaattattataaatttagtgttttaaaatatatatttgataatttatagttttgtaggttagaagtttaaaatgggttttattaggttaaaattaaggtgtttgtagggttgtatttttttttagaggttttaagggggaatttgtttttttattttttttggtttttatagatttattgtattttatggtttatagtattttatttttatttttagagtaagtaatggtggattgagttttttttattttgtaggattgattttgtttttttttaaatttttttttttgatttttatttttttgttttttttttttatttttaagtaatttttttaaagatttttatatttggtttatgttaataatttaggatgatttttttattttaaagttattttattagttattttaatttttttttgttatataatttaatatatttatagattttggggattaggaagtagatatttgtagggagttattattttgttgattatattatagttttatttttaattattttagaatttttattttaataataaaattaattattagttttttttaaaatttatagttttttatttatatagttttttgttattttattgagatattttagaaggttttagtatatggagattgaagatttaggtttaagttttgaattttttattttgtagtttgataatgttggaaaagttatttaatttttttaaggtttgattatttttttatttataaaatgggaataattgatttattttgtagagttgtaataaggattattatgtattatgaataagttttataaattgaaataattttttaaagtaaaggatgattaattgttttattggtttaaattatggtttggtttaaatataaatttttatgaagtaatttagtaatttatttagaattaatttatttttttttttttttattgtttttatattttttatggtataaatatattttgtatttgtgtgtatatattttttattttatttttgattattaaaattttaagggaagagtttttatttgattttgttttatattttatggtgtatattataatgttttttatataggtgtttattaaatattattttaaaaagtgattttaaattaatttgtaaagggtatttaattaagatgtttttatggaataatagtagagtaattgttaaataatattattgtaaaatataattttttattgaggaaatggaatattttaagttaaaattttggtttttgtatatggaaaaataaatgttgtgatgtagttatgggattaagtttttgagtttagttgttatattgtagaatttttttagtattttgaggagtttttaaaatattaagaaagaatttgtgggtagtgtttaagttttggtatgtgttgttagggatgagaaatattaagtatttttttagattttgtttttgaagtttttattgtattatagtagggaaattattttgaaatagttttttaatttggagtgttatatagttttaggatttgtttataggagaaagaaatttatttttttttgttaaaaagtttttttggtattttgtataagtattggtaattaatatgagaaaaaatatgaaggattaataaatatatagaaaaatgttttggttatgtgtaatggtttatgtttgtaattttagtattttgggaggttaaggtgggtagattatttgaggttaggagtttgagattagtttggttaatatggtgaaattttgtttttattaaaaatataaaatttagttaggtgaggtggtatatgtttgtagttttagatatttgggatgttgaggtataagaattatttgagtttgggaggtagaggttgtagtgaatagagattatgttattgtattgtagtttgggtaatagagtaagattttgtttaaaataaaataaaataaaattaaaaaaatttagaagaatgttttagtatattaaatgattaaagaaatagaaataaatataagagtattataaaaataggtaatgatattttaaaataatattgtagggttagtgaggatatataagtttttaaaatgtttattatgatttgagtatgttttttaaaagtttgtgttggaaatttaatttttaatgtaatagtgttgggagttgtagtttaatgggaggtatttatgttttatttttagtaatggattaatgtgttttattaaaaagtttgaggttataaatttgattttttgtttgttttggttgttttttgttttttttttttttattttgggatgatataataagaaggtttttattagatgttggtgttatgtttttggatgttttagtttttataattatgaattaataaatttttgtttattataaattatttagttttaggtattttgttatagtagtagaaaatggataaaggtaatttttatatttaagtaagtttaattaaaagaaattattttatgtatagatatttttataaagatttgtaatttggtattatttgtattattgaaatgttagaaaaaattttaataattattaataatagtttggttaattatatttttggtatatttataagatgattaaaattatgttgtaaaatataattatatgatatataattatataatttatatattatgtgaaaatgtagaatattgtttgtttaatatgatataaattagtttttaaaaaataaattgtgtatgtatatagagaaaagtagagagagataaaatattatgttttttttttaggaattataagaattttggtttttttgaattttataaaatttttataatttaatatatataatttttttttattttttttaagttaagtatttttaggtttgatattaattgaagttataatattagaggagagagaaattaatattttttatttaatttgtggttaaaggtagatttagattttgtggtgattagtagtttataataaaggggtagttgggtgggagggtttttaagaaaaatataaattaatttaagattgttagggttgtttttgtaagggttttagaaagggttatgtaattaggtttattaaattttattagttttatgataaatatgtttttaaattagtggtaaatattatgttaggtatttttatatatttaatttaataaaatttttatagagataaaggtattattatttatatgtatggaaaattgaggtttaaagaaattttaaaaagtatttaaatttatttaatagtgaaatggtagtttgtttttaaagttaatgttgattatattgttttattttttatgttttagtagtaattttttttattaaggtattttttagagtagtttgtatttttttaagttttattttttataaaaagttatttgtttaattgttattattttgatgtttattatatagtagttggttttgtagtagtaggtatttgataaatatttattgaatgaatggatttattataattagaataggtaaaaataagaaaatttaaatagatttgaaaatgtttttttagaatttataatgaatttatttataaatttttatttatgagaaaatatagatttttttggaaaatatttggaataaaatttttttaaatgtaggagatatttttatgttaatttagttaaataattaaagagaaatagagtttggggttattgtatgggtattagtaaataagaggtaatgttaaggagtgggtatattagtaaaggtaaaataaattagaaaaattgtgatgatttaataatttagttattttaagttagttttgttttattgtttttgtaagatattaaatatatattagattaaataaaatttatgtatgtaaaatgtggtagtatttaggttttgaagatttgttttttggtgttattttagtgaatatattatattatatggtaaaaggaatttggtagataaaattaagtttattagttagttgattttaaaattatgagattattttgggtagatttaatgtaatgatatgagtttttaaaaattttaaattgtttattggttttttagtgtaattagaataaattttaaattttttattttggtttataattttgtataatttagatttgatttttattattttttttgtttttttttatttattttttttttatgttttagaattattttttgtttagttttaaaaattttgtttttaaatttttaaatgattagttttttatgttatttaggttttggtaaaaatgttaaatttttaaagattatattttttatgattattttattaatgtattggtgttatttttatattttttattatatgatggagttttatattttaagtatttgagatttgaaaagttttatttatgtatttatttaattttttgttttttttattattgttttttaaagtggaatataaattttatgaagataagaattaagatttttttgtattgtttttttttttgtatttataatagtgtttggtgttttttgtttaatgtatgaatgtagatgatataataatgagtaagataatttataatttagaagaggattaagatatttatagaagaagttttaatataagggaatgtattgttaaagaatgggagattagattgtttttagttaggtaattaaaaaagattttagagagaaagtagtaatagaattagattttaaggatgtttaggaattttttagggtagagattttaatattgtgtgttaggttaaaaaatttagaatttattatataggtaatgaaaatattaagtattttaaataaaaagggatatataattagaataagatttatagatattataggattagtttttagttttggtttaagaggaaaaataattagaaattatatgtatattgttattaatttatagttgaatgtaatggttaaaagtttttttaattggaaaatatgattgtaggaaaaaaaaaattaagttatattttttataaaaaagtttataaattttatgatgttgataaaataaaaaaaaaatataattatttttggtaattattttatttaattaataaaagatttagaaaaaattgtgtgtaagaattttatttttttaaatttttaatatgttttaattggttaaaattttaattttaaggtatgtagtgttttttagggatgtttaatattttggtttttttgagtaatattggaagaattgttttgagttatatataaaatatattggttgggtatggtggtttatgtttgtatttttagtattttgggaggttgaggtgggtggattatttgaggttaggagtttaagagtagtttggttaatatggtgaaattttgtttttattaaaaatataaaaaaataataggtaggtatggtggtgggtgtttgtaattttagttatttaggaggttgaggtaggggaattgtttgaatttaggaggtggaggttgtagtgagttgagattataatattgtattttagtttgagtaatagagagagattttgttttaaaataataataataaaaaatatagtaatattattgatagttgatgagtttaaaaaaaaaaaattgtaaaaaaattttataatgttttaagatagtttatgaatttgtgttgggttgtatttaaagttgtgggttggatatgtttattttaaattatttttttttatggagggataaaattttgatttttttttttaagttaaatgtttaaaataaggttttatgtttgtttgtatatttaagtatgttttttttaattttttttaatattttgatttttatttaaaatttaaaatagttataagattgt

SEQ ID NO: 63 - DNA, 30714 bp, Artificial Sequence
  chemically treated genomic DNA (Homo sapiens)
tggtgtttggatttgttgtttaggttggagtgtagtggtgtgtttttagtttattgtaatttttattttttgggtttaagtgatttttttgttttagttttttaagtagttgggattataggtatttgttattatgtttggttaatttttttgtatttttagtagagaaagggttttattgtgttagttaggatggttttaattttttgattttgtgatttgtttgttttggttttttaaagtgttgggattataggtgtgagttattttgtttggtttgttttataattttttgtattttatatttagtgttaggtgttttggtttgagaagttgaaggttagataagtgttataggatagtttagtaggttgttaatttggtttgggagtgggttgttaaggttttttagagaaggaaattttagagttaaggttggaatgaagaattggagtttagtttaagttgaagtagaatttatatattaattattgaattgtattgggttgtatttgaagtaaggtttatttagagttttatagtttgtttttttttttttttaatataaatattaatggattaattattttttagaaggaaaaagaaagtaattaaaatttattgagtgttgattttatggtaattattttgtatatattttagttaattttgatatttgttttatgagattggtattatttatttttattttatagatgaagaaattgggagtttaagaggttgataaattttgtttaaggtaaaaaattgggaagtatagttaggattttgattgtaaagtttgtgttttttttattatattatgtggttaagtttgttttttaagagtttttttagtggatatgtagaagtagttaagaaaatagtgggattggttttaagttttaaggaagaaaaaattttttggttattttttttggttaaagaaagttttggaaaggggtttttgggttatttttttggttggtattgtagtgttttattttattaagttagttttgttgaatttggatttggggaagtgagagtttataggatattttttgggagtgtttgttgaggtttgttttatatagtttatattttgttgtaaatagtttgttgtttttaattaaatttgtatgattatgtgtgaatttttaggaaatgaggatttttttttatggttttttttttagtgttaaaattagagtttttgttagtttatgagtttttttaaattgttgggttttgattttgagattttggaatgtagtttagaaatgtttggattttggtataatatttagggaatgtttaagtgagaggatggttttaggtttgtagttatgttttttagaaggatgttttttgattttttttagtagggttttagggtattttaaatataggtttttgatgttatttatgttaggatagggaatatagattttttaattaaaattgttgtttgaagtaatttttgaagaaatagtattttaaaatgattatttttttttttagagaaagagttggttgaaattattttaatttgaaattgggtaataaagaaatgaatgggtttagttttttttaatgttgataaattaagaaaggaatatgtgtttattaaataaaatatgaaaaatatatataggtagaaagaagaaaaaaaagtgattatagttttattattgggagataattgttatttagtattttggttagtttttattattaaaaaaattgttttttttgtttttgtttttgtttttttttgagagggagttttgttttgttgtttaggttggagtgtagtggtgtagttttggtttattgtaatttttgttttttaggtttaagtaatttttttgttttttgagtagttgggattgtaggtgtatgttattatgtttagttaatttttatatttttagtagagagggggttgtattatgttggttaggatggttttgattttttgattttgtgatttatttgttttggttttttaaagtgttgggattataggtgtgaggtattatgtttagataaaaaatttgtttttttaaaagaattggttggatgtagtggtttatgtttgtaattttagtattttgggaggttgagataggtggattatttgagattaggagttgagattagtttggttaatatggtgaaattttatttttattaaaaatataaaattagttgggtgtggtggtgtgtgtttataatttttgttatttgggaggttgaggtaggagaattgtttgaattttggagatagaggttgtagtgagttaaggttgggatattgtattttagtttgggtgatagtgagattttattttaaaaaataaataaaaaaattgtagtaagaatatttaatataaatggtaattttatatttattgaatagtaattttgatttttggtgttttgtatgtttagagaaatttttttagtagtaaattatagaaaagatttttgaatgtgtgggttttttattatttatttttaatagtgagaataaaggtattaatttagttaatggttttagaatttgtttttttttttttttttttttattttattatttagattggagtgtagtggtgttaatatggtttattgtagtttttatttttttggttttagtgatttttttattttagtttttttagtagttgggattataggtgtgtgttattatgtttggttaatttttagtattttttgtagagaaggggtttgtttatgttgtgtaggtttgttttaaatttttgggtttaagtaattttttttttttagttttttgaatagttgggattataggtgtgtgttattatgtttagttaatttttggtattttttgtaaagaaggggtttttttatgttatttaggttggttttaaatttttggtttaagtaatttgtttgttttagttttttaaaatgttgggattataggtgtgagttattatgtttagtttatttttttttttaaggtggtattttttttagttttaatttttgtggatatatatatatatatattttaaatggggtatatattttgatataggtatgtagttataataattatattatggaagttgggatatttattttataagtatttattttttgtgttataaataatttaattttatttttttggttgtttagatgttttattttttttgtttttttttttttttttgagatagaattttattttgttgtttaggttggagtgtagtggtgtgattttggtttattgtaatttttgttttttgggtttaagagatttttttgttttagttttttaagtagttgggattataggtgtgtgttattatgtttagttaatttttatatttttagtagagatggggttttattatgttggttaggttggttttgaatttttgattttaggtgatttgtttattttggttttttaaagtgttgggattataggtgtgagttattgtatttagttgagatgttgtatttttaatgttaattttttaatttttgtttattgtgtgtattgagattattaagtgatttttttatatattttttatgtagatttgtattggttagtatatataatagttgtttggtatgtgtgattgtgtaaattttaaattagttaaaaataaataaaaattaaaatttagtttttttgtttagttatattaaatgtttaataattatatgagattaggggttattgtgttggaatagggaagatataggatatttttatttttattgaaagttttattagatagtgttggtgtagattttgatttgtttagtttagttttaagaataaagttttgagtttagtatggtggtttatgtttgtaattttagtattttgggaggttgaggtgggaggattatttaaatttaggatttgagattagattgggtaatatagggaggttttgtttttataaaaatataaaaaaattagttgaatgtggtagtatgtatttgtagttttagttatttgggagattgaggtgggaggattgtttgagtttaggaggttgaggttgtagtgagttgtgattatattattgtattttagtttgggtgatagatagtaagattttgtttttaaaaaaaaaaaaaaaaaaaaaaaaaaaaaaaaaaaaaaaagatagtattttttattttaaataatgatagaatgtagaatattttttagtaataagaaaagttattttaagaagtagtaaagagatgggtttatagtttttgaaaaggaagttagttattagttattttttgatattttagtaattagttggttttgggagaagagtaggtatttttagagaggtgttaaataaataggataagagattataaaaatgaaaagttttttggttttttattataggataatttaatgtatgtgaattaatggtgaaaggtttagtaatagtttttgtgaggaaataggagtagtgtagtaggatattttttttttgtattaaagtatttaatttttttaattttatatatagtggaagtaattaattgtattagaaagaaatttatagttggttttttttgatggttttataagtaataagtattattgtttagtttttgggatagatgtaaagttattttattgtattgttgagatttttttgaatgtttagtttgatttttttaaagataatttatgtgttaatatttaaaatttgatttgttttgttattatatatttttagtataagtaattgttaaaaagttaatttttattgtgttattgtattttagtttgggtaataagagtgaaattttattttaaaaaaaaaaaaaaagttaatttttgatttgtaatataatttagtatgtgatttgatgttggtattttttttaaatgttatgtgattgaattatgttatttatttttgtttgttttatatgtttatatgtagttgaattgtattgtttttgtttttgtggtattatttatagtgtggttatttaggaattaggtataataagattatatattaaaaatttagaaatttaatattttaaatgttggtttgtatggtattgttttattttttagatgtattaaaatatattatattttattaatttttagatgtatattttttttgatatttgaaattttttggaattgtgatattttaattaatgtgttagggtttaattggtaaggttttttttttttagttgtatataaaataatgatggattttataattaatagtatttatgttgttttttgggtggaaaaaatttataatgaaatagtattttagttttgatgatatatggtatatatagttaaaattttatgagtatgatgtgttattgtaagtgtaataatagaataattttttatttattttttttgagatatggtttttttttgttgtttaggttggagtgtagtggtatgattatagtttattgtaatttttgttttttgggtttaaggggtttttttgttttagttttttgagtagttgggatgataggtaagtgttattatgtttggttaatttttgtaatttttatagagatggggttttgttatgttgttttggttggtttggaatttttggatttaagtgatttgtttgttttggttttttaaagtgttaggattataggggtgagttattgtgtttggtttagaataattttttttattaagaaaaatatttatgttaattaaataaataaaaattttaattatatattttatatgggattttaattgattttattttgataaatatataatttgttatttttatttttttttttattaattaattagtttttttaaataatatttatttttttttttttttggtgttgaaatttatagttgaaaatatttatttttttgattataaaagtaatattgggttgggtatagtggtttatgtttgtaattttagtattttgagaggttaaggtgggtggattatgaggttaggagtttaagattagtttggttaatatggtgaaattttgtttttattaaaaatataaaaattagttgggtgtggtggtgtatatttgtagttttagttatttaggaggttgaggtaggagaattatttgaatttgggaggtagaggttgtagtgagttaagattatattattgtattttagtttgggtgatagagtagatttttaaaaaaaaaaaaaaaaaaaaaaaagtaatgtataatattgtttattgtgggggagataaagtttatggaagaaaataataattatttattaggttattatagaatattgttaatgttttttttttattttaggataatttatttttttataaatatatatatttaataatataaaattaataaatgtttaaatatattttgttaaatgttttgaaaggtatataatgttatataataaaaaagtgggttttttaagtaagttagggattagtttttttattgttattggagtagaattttttggtgtttgataggattatgtgtagatgttgtaatgtataattttagggagtattatttgtgttaggtaggttgtgaatggtatttttttaaagttgtgtaatttagtaattttggtgtttagtattgtgattatagtgatagtggtatatatgtaggggagatagataggagggaggatgtaatagtatagtagatgtattaaggagtttgtaattatttattaatttttaaaataatggatttgtagaagtaaggatttaataattggtaagttttagtggtttgggattgtttttttgatattatgtgtattttggtattttttaaattgttttttttaggttgagaggtttttatttatgttgaagaataaaggtatgaaaatttatttgtgagaaagatataagaatagttaagttatgtggaaagttagtgatgtagattattgagagaaaagtttaaggagatgaggatggagtagttaaagatgattttttggaagaggtggtatttaggtagtatagggaggagaatggtattaaatggagaatgaatatggtttattttttagaaagtagtgagattagtttaatgaaatgttattttatagtagtgtttttagatttaatgggattggtgttttataatagaaatttaaataattgggtaatattagttgaaagagggaatgattaattaggaggagagttagtagtatttaggattggaggaagaggggttttaaggtaggtagtaaattaaatggaaattaatttgtattttaaaataaatattgataagtattggttattggttatatatatgattatgtatgtttttgaaataataaaggaagttgttttaaagtttatttattgagaataagttgttagatgatagttttgttattatgatgtataggatttgttagtagatttttattttaataagataagtgttttattattaatttttaaaaatatggaaaaataaaataaaataaaatatttaattttgttttggttaatagaaataaaaagaaatgtgttagggtaaattattagtagagaataaaattaagtatgttatttatttaataaatatttattgattatttattggtgtgttaagtagtatattggatataatggagtgagaatgagatagtttttattttttgaatttttgagtttagtatagggttaggtatttttaatatatttgatgggtaaattagtatgtttggttatattggtgatattatattatatttaggaatatattttaattattatgtaagttatggatagtaggtatagtatggtgtttatgaatttgtatttttgatttagattttatttttttagttattttagtttgaattttttattattgtattttgttttttttttattagttatttttaaggtaattatatttagttttatatgttggatttttggattattagttttaaaggaatttttgagtagaattagtgtttagggatattaagaagaattagatatgggtttttttatttttgaatgtatgtatgggttttttgtgtgtatatatataaatatatgtatatgtatatgtatatatatgtatatatgtgtatatgtatatttatatatgtatatatatgtatgtatatatatgtgtatatatgtgtgtgtatatgtatatgtgtgtatatatgtatatatgtatgtgtgtatatatgtatatgtgtatgtgtgtgtatatatgtatatgtgtatatatgtgtgtatatatatgtatatgtgtatatatgtgtgtatatatatgtatatgtgtatatatgtgtgtatatatatgtatatttgtgtgtatatatatatatatatgtatatatttatatatgtatataaatatttatatatatatataaagtttagattagaaatttatttgaattatatttaatagattatatatatatatatttttattatatttggattaatttttagttagaaaaaaatatatatatagtttttttttttttgaaatagagtgttgttttgttgtttgggttggagtgtaatggtgagatttgggtttattgtgataagtgatttttttgttttagttttttaagtagttgggattataggtgtttgttgttatatttagttaatttttgtatttttagtagatatagggttttattatgttggttaggttggttttgaatttttgattttaaatgatttatttattttggttttttaaagtgtttgggattattagtataagttattatgtttagttaaaattatatataatatatttttaatatgtatttagtgtatgtttagagtatatatattatatatagtttttatttggttaaaaaataatttaagtgtaataaattaggtgttgtgaggatagggaaaagtagggtagtgagttgtagtaggatagggaaggttaagatttattgtgggttgtgtgggagttggggtagggaggttttagtttttggtgtttggtgggaggaattatagttttttaggtagtgtttgatagttagagagtagtgagtaaataataggtggtagtttaggagtgtagtggggatggggatatttagtttgaggtaatgggggaagggaggtttaatagatagatagaatatagatatagggagtttagaaataaagagttggaggtaattaagtgatgttattaataatatttataattgtttagtagtttgggtgtagggatgtagttaagtttaaataataagtagagaaattttaggttttggtaagttaataggttagggttttagatataagagaagggttgttagtttttagaaaggggtgaggtagtgggaggttgagttttgagtttgggattaaagttttgataattttttttgttttaaggtttaggaaagattaggttttatggtaaagggtgtatggatagtagggaaaggaggaatatagaggttatggattaggtaggattaagtgagagtagtaatattttttattatttattttttaattatagtagttagtgttttgaggtaaagataaattaaaatggagttaagggagaaggagtaagttgtttagaagtaaataaaagaagtaaaatattgtattattataatgaaaatgaatttaggtttttaaattttttttattttgtgtattgaattatatatatttattttatttttaattatagtttttgttttagtttagtttttttaagttatgatggggtattattaattaaaaaaaaaaaaaaaaaaaaaaaagatgtagtagtgtttatgttgaaaaatgaagttgtttattttttttaatatttatttatttaatattgggtttgaagttaatttaaagggttattttattaatggtatttttttatttgtgtttttttattggtttttaatttattattagatttagagattttgtgttgttttttgttttataagatttttataatatgaaaatgattttgaatggattagtttggattaatttatttattttggatttttgaaggtagaagttttattttattgaagaggatgtgatttatagtttttttagttaatttttattttttttaagatagttatgttattttttaatattaaaagggttttggtgataaggtttagaaatgtttagaggatatgtatgtttatttttttttttttatttaataaatatttatttgttaggtattaggttttgaggagagagttgagaatagattgataaagttaagttggtttgtagttttagttatttgggtggttgaggggggaggattatgtgagtttaggagttttaggttatagtgaattatgattatgttgttgtattttagtttgggtgataaagtgagaatttgtttttaaaaaaagagagattgataaagttttttgtttatggagtttatattttagtggagtagaggggtttagattataaataaataattaaatgtatgatgtaattaatgaatgttgttttgggtatgtaataattattttttttgtgatttatttggatagaagaaaagattatttttagtttattttagtaatttatttaaaggaatattaatatattatggaatgttaattgtggattttgagatgttgtttttgagtttgggggttagaatatatgtgtttagatgtttttttgggtagatagattggagaaatgggttggtatgtataaatatgttagtagttagggagaatagtatgttttattagttgttggtagttagggtgttgaggattgaagtttgggtattagttgggttttattaaaggagagtgaaaaatttttgaagatttgaaaaggagagttttttgtagagaagtaaatatattatgatttaaaatttgatgttttaattttgtttttatttttatagtggtagataatataagttagggaatatttatttgtatattttagaaatttgatgtattaaggtttttatttgagattgttgtttattttatagattaatttatatgtttaaaaatttaattagattataaagagtataataatatgtttgttatggttttttttgttgatatattgtttagtatatgttaatgagagttttgattaattaatgtgaatttttttaagtaaaaggtttatttttttttttagaattaaagttggggttgggtgtagtggtttatgtttgtaattttagtattttgggaggttgaggtgggaggattatgaggttaggagattgagaatatttattaatatggtgatattttgtttgtattaaaaatataaaaagttagttgggtgtggtggtgggtgtttgtagttttagttgtttaggaggttgaggtaggagaatggtgtgaatttaggaggtggagtttgtagtgagttgagatggtgttattgtattttagtttgggtgatagagtgagattttgttttaaaaaaaaaagaataaaaaaattttaaaaaataaaaaaattaaaattgggtattatgaaggaaatttgagaaagaaaagtgattaattttagttgatgtaagtaattttatgtatttttttttttttgtatagtaagatattataatttatgattgttaaatttgagatagttgaagagtttagaaaaaaagattagggaagaaaatagaattgaaaaataatttagaatgatagaggttatttgtagtattaagggtaaaggtgggtaaaagaagaaaagggagatagaataaaagataaattaaaaaattgaaataaaatatatgggaatttaaatatttatattagaatataagggaatattttggaatttaaatatttttttaggtaagaatgtgtgttaatataaatgtttggtatattgttttttttttttttttttttttatttagtttatttagttttaaaagtgattttttaaaatgtatttttaaaagaatattttttgttaagtgatttaaatttgatatattttttggattattaaggaggttaaagttatatttggtgaaaaaggggtttattttttttttttttatatatgggttattgaatatttttaaaagtattttttattatgaatgaggggaaatggaagaaaagaggtggtgataattatttgtattttttaaatggatggaatgagtttttggagggtatatgaggttattagtgtgagtttgtggtggagttggaggtgtatttatagttggttgattttagttttgttgggtttttgttgttttttattttatgttgttggaatttgtgggtttgtaggttataggagtttgggtgtgttgggtttggtgtttttgaattgatgagggaagttgttttttttggtagatttttttggttggggagtttttattattttgtttgtgttttggtatgttggtaaggagtttgggaagagatgttgggagtggtgggtgggtgagaaataaatgtaatgtgatttatatttttttttgttgtaattattatgatttggttattttttattttggtgatttggtgtttttttagtgattttattttatgttagttgattggtgtttattgtagtgtgagtgttggttggaggaggggtttatgtgaaagagtttgtgagagtggggatatttggttttgaaggttggagtgggtgtttagggtgttgatggttgtagtgtttggtagttgtgtttatgtttttttttgttgtgttttattgtgtgttatttatggtgtttgtgggaagttatttgggtggtagttgtggggttggtttgtggggaggggttggtgggtttgtgtggaggagtagttttgatttttgtttgtattagtagtttggtgtttttttgttggtggttggtttttttttttggtaattgggtgttgggttttgtgaattttttgggtgtttttgttgtgtgtttggttttttttgtgtttggggtggggtggggtaggtgtttgtggttgggtgtgtgtggtgtgggtgggggtttttttagtgtgtgtgtgttgtgtaaggtttgtggatgtttgttttttttttaggtttttgtatttgtgttgttttttttttttttggtaagagttggtggtggtggtggtggttgttgtagagattggaatttgtttgttgggtttggtgaaggagaagggaggaggtaggagtgaggagggaggagggttaagggtgggtaggaaggtttaggtttggtgtgtttgtttgtgtgtggtgaagattgtatggtttgattgaggggtgattgggttggggttgttgtatgttaagggtgaaggttgatttgggttttattttgttttggtggtttgttgtgtttatttgttttgtgttgagggttggaggatgtgttttttggggtttgggtgagttgggagtgtgtgtgtggattggaggggttggttgtagtggggaggttagaggggtttgggtgaggttgtagaggtagttgggtgtgtggtggttggagttaggggttgtttggtttggttttggtagttttgtaggttttggtgtgtgttgggttgggattgtttagttagagatttatggtattttgtgttgtgttttttgttggttttttttttgttttttatttgtgggttgtaggttgagtttggggatgtggagtgggtgaaagttgttttggggatgtttttggaatttttaaatgggaaaggtgtttatttttttgttttggagtggtgaggttgatatttgtgatttggttttggatgttgtggggaggaataggggagaataaaatgagttttgggtgggggttgagtgagaggagtagttggtttgtttttgagtttttgtgggaaggggttttggtttttgagtttttggagttgttttatttgttgttttgtgtggtttttgttttgtggtttggtgattttgtattttagttttggaaaattttttgttggattgtttggatttttttttttttttttagatttttagtggaaagatttggtaaggaaaaaaaaatgagtttgtgttagggaagaaaaataatatgttgtgtgttagggtttggtgtttgagtgtggtatttttttatgtttttagatgttttaatttggttaaatttttgtaggtttttttttttaagtggttaataaattgtttagagtatatagtatgaatttggtatttgtgttatgttatttaatttttataatgattttggtttattgtattttttattgttttaggggaagaaattgagttgtaaagaggttaattaatttgtttaagggagttgggatttgaatttaggaatattgtattttggtaaatgaattaggaagaaaaaaaattaaaattgtttgtaaatatttttatgtttaggaatattttttagttatttttatttgaaattattgttattttgttgttggagttgaaaataattattttattgtatttatttgtgagaggagttaaattttgaattagagtgtaatttaatgtgttttattgtttttagttgttgaaataaagaatgtgaattagaattatttagatttttaaatttgaagttaaaatatgggtaattttttgatttaggaatggggtgagtgtatgaaaggttgattgaaatgtagaatgtgtttttagtagaattagatttagtttttgtttaattttttttttattttttgtggagtttattttaaattttttttattttttttatttttttttattttttatagaagaggttgaggtatttagtaggagtttttttattaaattttttttgttattggttttttaattttttgttaaagagggagaatttttttttttttttttgttttttttattagttaatattttggggttttttttttttttttttaatttttttgtttagtggagtgtgagttattttttttgttgtatttgggttttttaaagtataaatgtttttaagatttttttagtttataaaaatttttttttaagtttgttatttttttaagttgttttgttgttgttttttttttttaaattttattaatattttaaaaagtttgtttgtaataaaagtaatatatggttgttaattgtgaattagtgtaatattgaaattaaaatttagttatttataatttatttttagagattgttaagtgtagtttgttttttttgtttttgtttggttggtggttagttatttattttttaattttttgttatttggattttatttttataaggaattataatttaattaatatatttaattatttttttttaagttttttttttgagttttttgtaagatttaatattgattttatatttttagatgtttttttttgggttttatttatttatatttgttgtattttaatatagggtttaaggtagtaagatataatagattttttttttatggagtttaaagtttagtggggaaatatttattgaaaaataaagtttttagttaaatataattgtgattttaattaaggtgtagaatattataagaattttaaatggagatttgatttggtgtttgtggtggtgggagaatttgggaaagatattttaaaattgttttgttggaatttaggtagattgtgaaggatgagtaagagttaattattaattagatgaagaggggttttttgtgatattatattgattttgtttttttttgttatttttttgttttttgtttttttttttttttttaatatgtgttttttaagttttattttttagattatttttttttatgtttttagttttttagaatgattgtttagatttttttgttggaataatttttaattttttgtttatgtgttttttgaattatgtttttttgtttgtttgttttgtttttttttttttatttagttgttttttatatatttgtatttgattgttttgagttgtttttttttagtaaatttgtttttttggtgttttttatttttgttgatgttatattaaatttaaatttttttttattttattatattttgtttgtagttaatatttgttgattttgttttatgatattgtaatttttttgttttttatttttgttaattgtggggtaattttgaatttatattggtgtgaaggtagtagttaaattataaaatgagttgggtagtttttttttttttttttttttttaggattattttagattgggattatttgttttttgaaagtttggaagattttttttatgtgattatttaggtttagattttttttttggagaggattttgagtaatattttaatttttttaatagttgttggtttgtgttgattttttgatttttatatgaattttaatgttttatattttttttaggaatttatttttaaatttagtgttatttggtttttatgtagttttttttttattattttgtgattttatttttattttttaattttaaattaagtttttattttatttggattaatgttatgatttttttgtttttattttttttttttatttaattttatgtatttttgtttaaattaatttgtaagtttagtttttattattttgttatttagaagttttttaggttttttattaaatgaaatattttttgtggtatttgttttagatttatttgtttttttttttttttttttttaatattttattgttttttttttttttttttttttttttttttttttttttttttttttttttgatatagagttttgtattgttgtttgggttggagtgtaatggtgtgagtttagtttattgtaatttttgttttttgggtttaagggatttttttgttttagttttttaggtagttgggattatgtttggttaatttttgtatttttagtagaggtggggttttgttatgttggttaggttggttttaaatttttgattttagttgatttgtttgttttagtttttttgtgttggggttatataggtgaggtattgtggttggtttttatagtagtttttatataaatattagttttattattagtttgtagggtgggtttgtaatggattttttttgtatattaaaaggaataaatggggaaaggtttttgtttagtttaatagtagttgttgaattgttttgatttgattattggattttaggagtagtgaattatggagagaaaggaaaatgggttttttattatattaaattttgaagtaggaattattttttttttttttttatttttttattttttattagtttttaggttttaggatgtttttttaatattataaggtttatattgattaagttggattaattttttaatataagattaaatgttgatttgtattgagttatgtttattgtaagatatatagtagtgttatagattatttaaaatatgtttttagttgtaagaagttattgattgtaaggtgtattttaattttggagatgttaaaatatgaaaaatggatgtattttagaattgatgaatagtgtttttttttttaattaaagtttttggatgtgtttggaaatttttagtagtgttttttgaaaagaatattagttaggggtatagggagattagatgattagtagattttattttagggtggtttttgtggtttttaagttagtttgtatgggtagtttaatatataattaatgagtagatattgaatagatgagtaaattatttttgagtattttttatttattttgatgttgtagattttgttatttttttatagttttatatttttgatgagttttttttttttatggtatagatttgttatattgttaaagtttggaatagtggagtttggtttttgatttagttgtatataattggttgttgatttatgaaggaggataggagtatgttagagatagggataaaatattataattatatttgtagttagggagattagttatatgttggaaaattattttgaagaaaggaagattgaagatgtttaaatttgtaggaaggtttttttggtttagtttggattaaatttatttatgtttagtgttttattattggaatgttaagtatgtgggagttatttatattttgtttaaggttattattaaggtttgattgtaaaaatttaaaaaattgtagttttaggtataaatgggttaagatggtggtagataattagggtttggaatggataggaggtgataattagtgtggatgagagaaggaatgggattggtaagaataatttttggatttttagtttggaaagtagggtagatgtgggtgatagatatgaaaaatgaggtgggagagttggtttgtagaagaaaatagtattggattatatggagtttgagatatttgaaatagttaagtagggatttttatttggtagttgtttatatgggtttggggtttgatagaggtttgtgttggaggtaggtatttgggagttattgttgtatagattttatattttaatagtgggaattgggtggtttttttaagtgatttttgtttataagtgatagttttaatttaagttagtttaaaggagggaaaagtttttttttattaatttttatgatattgaaaggtttagaaatagatatggttggatttaagtgtttaaatgatataattaattgaggttgttttttttgttttttatttttgtggttttattttaggtaggtgtatatatttggtagaggaagatataggttataggttatagaattataggttataggttatagattttgtattgagaattttttgtatggtttagtaaagagtttaaaatagtattgagaattttttttttttttttttgagatggagttttgttatgttttttaggttggagtgtagtggtgtgatttgggtttattgtaatttttgttttttgggtttaagtgattattttggtttagttttttgagtagttgggtttaataggtgtttgttaatatgtttggtttttttttgtatttttagtagagatagggttttgttttgtgggttaggttggttttaatttttgattttaggtgatttttttgttttggttttttaaagttttgggattataggtgtgagttattgtgtttggttagttttgagaaattttaatttaaggtttgggtagagaagatagatattaaataattatttagttgtagttatgttaagatttataaaaaggaagtttagggaatgttataagattgataagggaagttgggttgtttaggatgtgggtattttggaaggtttttttgagaaaggtagtttgtagagtgagattttaggtaagaaaggataaggagattgtttttggaagtatttagtagtatttatttatttatttgagatggagttttattttgttgtttaggttggagtgtagtggtgtgattttggtttattgtaatttttattttttgggttaagtgatttttatgttttagttttttaagtagttggggttataagtgtgagttattatgtttggttaatttttgtatttttagtagagatggggttttgttgtgttggttaggttgattttgaatttttgattttgtgatttgtttattttggttttttaaagtgttgggattataggtatgagttattgtgtttggttagaagtatttggtaaagtgagtagtttttgtagttttttaaaaattttaaaggtaatatatttattgtgggtaatttgggaagtataaaaagttataaagaagtagtggaatgattaagttttagtttttaattttttataaataatgtttgatattggttttattattgagtatttatttaattatggatgttatattaatttaatttgaatttttgtttttttattttaaaaaatagaaggaatatggtgaattttaagataatttttttgtttaaaaaaagaaaaagaaagaaaatattttgatttgtagtatagttagttgttgaaattgaaggttatataatgtttttggttttaatgatattattggatttttgatttttggttgaagaattatgttagttttggtagtttttgtaagtattaaagggagtatggtttatgtttgtggtgttttttttgtattttgtttttttatttttttttttgagtattaatttttttttttttagtttttgggtaaagtattaaaatgttgagaagatagatttttaattttgaaggtgagaaatttgtaggagatttggatagttgtttttttttttttttttttgagatggagttttgttttgttgtttaggttggagtgtagtggtgtatgttggtttattgtaagttttgttttttgggtttatgttatttttttgttttagttttttgagtagttgggattataggagtttgttattatgtttagttaattttttttattttttagtagagatagggttttattgtgttagttaggatggttttaattttttgattttgtgatttttttgttttagttttttaaagtgttgggattataggtgtgagttattatatttggttgatttggatagttttgatattgttttatgtatattaagatttgtaggtagtttttttattagtaattaaaatgttttgtaatgtattttaagagtatagggttttgagtgttttaaatttgtatataagaatgttttagatttttggttaaaagaagtttttgttagaaaatattaaagtaaaggttgttaaattttggtgaggtttttaatgtttgtattttttaagaattatttaaaaatgttatgaaataaaaatattttagtggtaattgtttagaagtattttaaatgtatattaaattaatgaaatataattgttgggtgatagattattttttttttattttataattttttatttaataaaaatgtgggggaaaaattgtatgttgaagttgtatgtgtatattttagtaaaaattgttaatttttttgaagtattgttttggttattatttttatttgttaaatatttttttttgtttttttatttgtttataatagaaaatttagaatattttggattggttttttgttttggttaagttagttttttttgttttgtttttttttttattattttattagtttaagttatgtaaatatttgatttaggtttgggtttagaatttttagatttttattgtttattataatagatagttattattatatgtggttgttgaagatttgaattgtggttagtttaagtgtgaattatgtattagattttgaagatagtattaaaagatgtaaaatattttattatgtttttaaaatattggttatatagtgagatgatattgttagggatatattggattaaagaaatatattaaaattgattttggttgggtatggtggtttatgtttgtaattttagtattgtgggaggattgtttgagtttagtagtttgagattagtttgggtaatgtggtgagattttgttttagttaaaaaaataaaattgattttataggattttttttattttttaaatgtggtaattagaaagtttaaaattatatgttatattggatagtattgtttttgatttttttttttttggttttttgtttattagaatgttttaaaatttagtataaatttttggttaggtgttgtggtttatgtttgtaattttagtattttgggaggttgaggtgggaggattatgaggttaggaatttgagattagtttgattaatatggtgaaattttatttttattaaaaatataaaaattagttgggtgtggtggtatgtttgtaattttaggtatttaggaggttaagataggagaattatttgaatttgggaggtggaggttgtagtgagttgagattgtattattgtattttagtttgggtgatagagtaagattttgttttaaaaaaaaaaaaaaaaaaaaaagaatattttttttttttttatgaagttttttttagtggtttaagttttatagttggttttttgttgtattattatttgaagataattttttggtatattagatttttttattataaatttttttagaatttttaatatgttaatatatatggtgaaattttagtatagtttttttaattatgtattattatagaattgtgtgttttttgttaatagaagttatatatatttgtggttgaaattttaaataatatagaaatgaagtaatgaaagttttttgtaattatgttttatttgtgttttaagattgttattgttgaaagtatagagttagaaaaaatttttttttttgttgttttttttttttttttttgtttttattttttaaaatggggttatatgatatatttttatttttaaatttatttttattgaatatatagggggattttttttatgttagtaaattttaatttttttatttttttttttttttttgagggaaggttttgttttgttgtttaggttgtagtggtgttgtggtgtaaatagtttattgtagtatttaatttttgggtttaagtaatttttttattttagttttttgaatagttgggattagaggtgtatgttattatgtttagttaattaaaaaatttttgtgtgtgtggaggtgggattttattatgatgtttaggttggttttgaatttttgggttaaagtgatttttttatttaggttttttaaagtgttgagattataggtgtgaggtgttgtgtgtagttttaattattttattttttatagtagttaagtagttattttattttttgattatattttaattttatttattagttttgtgttaatgaataattagattatttttattttttttttttgtattgtaaatatgttgtggtgtttgtatatattttttgagattgtttttattttatgaaatgaatttttagaaatgtatttattataagagaagttgtgtagattggatggaaagtgttaagttattttgtaaaatttttgtaattatttatattttagttaatagtatttgaatatgttttttttttttaatataattatattagttttttttttttttttttgagatggagttttgtttttttatttaggtgggagtgtagtggtgttatttttgtttatagtaagttttgttttttgggtttatgttatttttttgttttagttttttgagtataggtgtttgttattatatttggttaatttttttttgtatttttagtggagatggggttttattgtgttagttaggatggttttttttttttttttggagattgagttttgttttgttgttaggttggagtgtagtggtgttattttggtttattgtagtttttgttttttggatttaagtgatttttttgatttagtttttggagtagtttagataataggtgtatgttattatgtttagttaatttttgtatttttagtagagatagggttttattatgttggttaggatggttttgattttgtgattttgtgatttgtttgttttggttttttaaagtgttgggattataggtgtgaggtattatgtttggttatattagtttgtttttatttttgttagtttgttagttgaaaaaatatttatgatataaggtttttttgttgttgtatgaatattaaaaaataaaaaattttaagttttatttgttttatatttttaatttgttatatgtttttttgatttttgtgttaaaatattttgtattgttaatagtatatatgtatgttttgtataaagtaaatgtttagatatttgtatttgtttatggtaaaggtgtttagaatatgttattgtaatataaaaattatttggaaatttggtggtttatgtttgtaattttagtattttgggtggtggaggtaggaggattatttgagtttaggagttttagattagtttgggtaatatgttgagattttgtttttataaaaatttaaaaattaatgagatgtggtggtatgtatttgtagttttagtaatttaggaagttgaggtggggggattgtttgagtttaggagtttgagattgtagtgagttatgattttatattgtattttagtttgagtgataaagtaagattttgttttaaataaataaaatatatattttaatttggaaatatttgagaatagtttttttttttttttgaatttttttgtttgtttaaaattagatttttttttaaagaatttaattgttataatttttagttgttataaattttttttttgggagttttgtaagtagggaagatggttttttgttgttggagagaatttggtattatatttaaatagatattgttataaattattttatgtttaattgttgttttaagggtttatttgttttttttatatgttatttgtttttttgtaatagtttattgtttttttttagttttagtttttttagtaagatggtatatatgttttaaatttggatagtttttttgggttatatttttttgtgaattattttatatatgtgaattaaatttgttattttttttgtagatgtgttttttgttagtttaatttattagattttaattattgaatttaagagggtgtaggaagttttttttttttgataatggttaaattgatatttttttggttgtaagggtaagggataataataaagtaatgtttttttaagaataaatataaatattttaaatataaagagtgtgagtaaagtttttttaaagtatattaaaaaaattgttatttaaaatgaaatatttgttaaaagaagtggattatgttattaaagatgtgttttttatttttatgtgtttgtttttattgtagtaatgttgattgttaatggatggtatagtaattttaattgtgtttataggtttttgtttttaaaattatgtatttttttttgtttttttttagtattttattaatttgtatagaagagaaaatgatttgtaataggtttttttggttatattattgaggagagttaataaaagaagttatttaattgaggttaaatttttatataaagaaggtattaatagtttaaaagaataaagaaattttgatatggttattgtgatttttttatttatttggttatgaaataattaaaaaggttaattaaatgttggtttatttttaggtttagttatgtattggtgtgtttattgttttttgtgttttattatattttgtttattaggtttgtgattttgagttaaagttgttaattattttaagttttttttttttatatgtgaaataaggataataatggtttttttttttagggttattgtgaggattaaatgaatgatgagtgtagtttagtgtttaatattgtgtttgttattgtagtagtttaatgaatgttagtgaagatgagtatttttgagagaaataagtaggatagttttattttaaaatgtaggtttgaatggttttatatatagggtttttgaaaattaaatttgattttgttgttttttaaaagtatgtattattttagtttttatgttaatatttatatttgaatttgtaaaatgtttttgtgtattattagtattggtaaattgatataggaaattttgttgttttttttgttttgtatattaagaattggaggttaatgaaggttaatttttttattaatgttaaataagttggtgtaaaagagtaaatagatttagagttgaattttgtagttttatttattagggaggttgaggtgagaggattatttgaggttaggattttgtagttgtaatgtattatgagaataatgtgttatgtaaatagtaattgtgttttagtgtggataatatagtgagattttgtttttaaaaagaaaaaagtaaatagaattagatttttttttatttatttagagtggatgattaggattttaaagttatatataaagtaaagttaaagattttatatgttaaagaaagttttaggtattagtggttagaattttttttagggtttattaagatgtggtagaattaggttataagttggggggagaaggaattgtgttagaattgttattgtagttattagtttgtttagtagggagtattgtagttttttttttttttttttttttttggagtgttttttttttagaaatttagtgtggagaggtttaagagaattatttttggaggttaagaatattagtagaagatggaatggagtatttgattatttaggtagtattaattatgtagtaggttggtttatttgtatttatttgagtaaaggataaggaaaattagaaattttagtgtggatggaggggtggtagtgatttttttttagtttaggtgggtaatgtagatgtaattaggtattagtttttttgttaggtaggttgtgttggataggggagtaaaagtagttggaagagggtgagttgaggttgggtaaggtgatgtagatttataattgtagtattttgggaggttgaggtgggaggattattgagtttaggagtttgagattagtttgggtaatatggtgaaattttgtttttataaaaagtataaaaattagttaggtgtggtggtgggtgtttgtggttttagttgtttaggaggttgaggtggtagattggtttgagtttaggaggttgaggttatagtgagttgagattgtgttattgtatattagtttaagtgatagtgaggttttgtgttatatttttagttttttgggtaattgaggtaggaggattgtttgagtttagaaggttgaggttgtagtgagttatgattttattattgtattttagtttgtgagagagagattttgttttaaaattaaataaaataatataataaatggagggtgagttgaagtagatttttaggtgggttgagagtttttagttttttttgttatgaaagaattttatttgtttttagaagaaaagttattatttgtttgtttgtgatatagatagtgtagttagtattagttaggaaagtggtaattgagatagttattttagtttttttttttttttttttatttattagattatatttttttttttaggttagtttttttggattgggtgtatttaatttgaatttgaagagaaaggaggtgattgtaagattgaagattaatgttttaaattgtattttttaataattaaaagttataggaattttttaagatttttataagaagtggaaaagggagatttgattaattataattagggatagggatagagaaataattgttttttgtgtttgtattgattttagattttttgttaagagttttaagtttttattattttaagtttttattaaggtttttggatatattaagtttttattaagtttttattaaggtttttggatattaaattttattttttttttttttgtatgaggttgttatagtattatagatgattatttgatttttttagtggtttgtttttaaatgtattttgatttttaatattattttagtattaagtgtattatttaattttattttagatttataagttgtatattatatgataatttttttaattggaatattaatttaaatattttaatttttttttatggaattgttggagtttattaaattttggaaatgttaaataatataaaaagtatttaaaaagaaatattaatttaatattttatttttatttagtgtttgagattttgaattttagaaagttttaaattaatatttagttgttatttatatataaaaggtaagtaggttttagtttaaagaatgttgagtaataaaatataagattgagatggattaaatggtatttgatatatttttttattttgaattgatttaatttttataagtattttatgatatagttattattattagtttttttttatatgaggaaattaaggttgtagaggttaagtagtttgttaagggttgtatagtttttaagtggtagagttgggatttaaatttaggtagtttggattttagagtttatgtttttaattatataattatattgttaaatggaggaggagaattttaagatgaggatgtgtattaggtatagagttgatttttaataattaattttttttttaatatttaaaatgtggtagagattttttatatttaaattttttatagttaatttttgagattgattgattgattgattgaagtagggttttatgtattttattttttaggtaggagtgtagtggtgtgaatatggtttattgtagttttggttgtttgggtttaagtttagatttttttgttttgattttttaaagtgttgggattatagttgtgagttattgtgtttggttttaatttatatttttttattttattgattttgttttttttttgtattttaaataatattaaaaggttagtggtatatagttgtttaaaaaaatatttatttaaaattttttttatatattttttttaaaaattagtgttttttttttttttatttttgagatgtatatatgtttaattggtgatggttagagataggttttttttttttttttttttttgagatagagtttttttttgttgtttaggttggagtatagtggtatgattttggtttagtgtaagttttattttttgggtttatgttatttttttgttttagttttttgagtagttgggattataggtgttttttattatgtttggttaatgttttgtatttttagtagagatggggttttattgtgttagttaggatggttttgattttttgattttatgatttttttattttggttttttaaagtgttgggattataggtgtgagttattgtgtttggttagagatagatttttttttatagttttattatgagtattatttttaaaataaatgattttgggtaggtgtttgtataatataattatgttatttgtattgttttatagaataaattaaaatttattttgtgagagaataagaagaaaaagagagttagttgaaaatgaaagtgattaagtttatttgtggggtagtttttggagttagattgagaaatgaaatttgatttttatttgttaatgttgttgaataataataatatggaatattattaaattgtttttgtttttttaatagttatttaaatgtaattggttatggtatgtagatgtttaaaaattattttatttttttaaagtttttttttaaaataagtttttttttttttttgattgtaaaaataatgtttatagaataaattgaaatatatagaaaagttttgagaagaaagtaaaaattttttgtatttatattatttaaaggtaatatttataaatattttggtatatatattgtaagtttaaaaaattttataatgtttttattgtaatttaagaatttgtgtaaataagttgagtaaagttaagtttattttgagtgtttgaatttggaatataaggaatttgaaatttgtaggggtgggggtatttgaatagaaatagaaagttttgaaaatttggttgttttattttagttatttttttttttttttttttttgaatgtttttttttttttttttagtttttgttatttttaagtttttttttttaattaagatgttttatatttgatatgttttttagtaataatagattaaaatataataagatgtagggaagtagaatttaaattgtaggaggttaaaaattagatgaaggttaggtgtggtggtttatgtttgtgattttagtattttgggaggttgaggtgggtggattatttgaggttaggagtttgagattagtttagttaatatatagtggaattttgtttttattaaaaaagtataaaaattagttgggtatggtggtgggtatttgtaattttagttatttgggaagttgaggtaagagaattatttgaatttgggaggtggaggttgtagtgagttgagattatgttattgtattgtattttagtaatagagtaagattttgttttagaaagaaaaaaaaaaaaaaaaaaaatataatattagatggaaatagaaaatttaaaatttttagtagaatgaagttagaaagaatggaatttaaatattgaaattatatatttgttaggtagttgtgtgttttttatttataggttttgttgtggaaatagtaaaagaaattttgaaagaaaaagatattttaaatagattaagtatatatttttattattgtgatatgtatatttttagttgtatagtatgtattttattttttttttttttttttgagatagagttttattttgttgttaggttggagtgaagtggtgtgattttggtttattgtaatttgtgttttttgggtttaagtgatttttttgttttagttttttgagtagttagaattataggtgtttgttattatatttggttaatttttgtatttttagtagagatagggttttattataatggttaggttggttttaaatttttgattttagatgattgtttgttttggtttttgaaagtgttgggattataagtgtgagttattgtgtttagtttttaa

SEQ ID NO: 64 - DNA, 30714 bp, Artificial Sequence
  chemically treated genomic DNA (Homo sapiens)
ttaaaggttgggtgtggtggtttatgtttgtaattttagtatttttggaggttgaggtgggtgattatttgaggttaggagtttgagattagtttggttattatggtgaaattttgtttttattaaaaatataaaaattagttaggtgtagtggtagatgtttgtaattttagttatttaggaggttgaggtaggagaattgtttgaatttaggaggtataggttgtagtgagttgagattgtattattttattttagtttggtgatagagtaagattttgttttaaaaaaaaaaaaaaagaatgaaatatatgttgtatagttaaaaatgtgtatattatagtgataagaatatatgtttagtttatttaagatattttttttttttaaagttttttttgttatttttataatagaatttataaataaagaatgtatagttgtttagtagatgtataattttagtgtttagattttattttttttagttttattttgttagaggttttagattttttatttttatttggtgttgtgttttttttttttttttttttttttttgagatggagttttgttttgttgttggagtgtaatgtagtggtgtgattttggtttattgtaatttttattttttgggtttaagtgatttttttgttttagttttttaagtagttgggattataggtgtttgttattatgtttagttaatttttgtatttttttagtagagatagggttttattatatgttagttaggttagttttaaatttttgattttaggtgatttatttgttttagttttttaaagtgttgggattataggtgtgagttattatatttggtttttatttggtttttaattttttatagtttaggttttgtttttttatattttattatattttagtttattattattgaagaatatattaaatgtgaaatattttgattaaaaaaaaaaatttaaaagtggtaaaagttgagaaggaaaggaagaatatttaggaaaaaaaaaaaaaaaagataattagaataagatagttaaatttttagaattttttatttttatttagatatttttatttttataaattttaagttttttatattttaggtttagatgtttaggatgaatttagttttatttaatttatttgtataaatttttaaattatagtagaaatattgtagaattttttaaatttatagtatatatattaaaatgtttatagatgttatttttgagtagtataaatataggggatttttattttttttttagggtttttttatgtgttttaatttgttttgtaagtattatttttgtaattaggagggaaaaaagatttgttttgaaaagaaattttaaaggaatgggatgatttttagatgtttatatgttataattaattatatttaaatgattgttaagagaataaaagtaatttaataatattttatattattattatttagtagtattaataggtaaaaattagattttattttttaatttgattttaaaaattgttttatagatggatttaattatttttatttttaattgattttttttttttttttgtttttttatagggtaggttttaatttattttatgaaatgatataaataatataattatgttatgtaagtatttatttaaggttatttattttaagagtaatatttatggtaaagttgtgaaaaaagatttatttttggttgggtgtggtggtttatgtttgtaattttagtattttgggagattaaggtggggagattatgaggttaggagattgagattattttggttaatatggtgaaattttgtttttattaaaaatataaaatattagttgggtatggtggaggatgtttgtagttttagttatttaggaggttgaggtaggagaatggtgtgaatttgggaggtggagtttgtattgagttaagattgtgttattgtattttagtttgggtgatagagaaagattttgttttaaaaaaaaaaaaaaaaaaaaaatttatttttgattattgttaattaaatatgtatatattttagagatgagaaaaaaaaaagtattaatttttaaagaaggtatgtgggaagaattttggataaatatttttttaaataattatatgttattgattttttaatattgtttaagatgtaaaggaaaaataaaattagtaaagtaaaaaagtataaattggagttaggtatagtggtttatagttgtaattttagtattttgggaggttaaggtgggaggatttaagtttgagtttaggtagttgaggttatagtgagttatgtttatattattgtatttttgtttggggaatggaatgtgtgagattttgttttaattaattaattaattaattttaaagattaattgtggaaaatttaaatgtggaaaatttttattatgttttaaatattaaaagagaggttaattgttaaaagttaattttgtgtttagtatatatttttattttaaaattttttttttttatttgataatataattatgtggttaagagtatggattttaaaatttagattgtttgggtttgaattttagttttgttatttaggaattatgtaatttttgataagttatttaatttttgtagttttagtttttttatgtaaaagggaattgataatagtaattatattatagaatatttgtaaaggttaaattgatttagagtaaggaaatatgttagatattatttaatttattttaattttatattttattgtttaatattttttaaattaaaatttatttattttttatatgtgaataatagttgaatattaatttaaaattttttaaaatttaaaattttaaatattaagtaaaaataaaatattgaattagtgtttttttttgagtgttttttatgttatttaatgtttttaaggtttgataaattttaataattttataaaaaggaattaagatatttgaattaatattttaattaaaagggttattatataatatatagtttataaatttgagataaaattaaatgatatatttaatgttaaaatagtattgagaattagaatgtatttggaaataggttattgagaagattaaatggttatttatagtattgtgatagttttatatggagaaaaagagaatgggatttggtgtttaaaggttttggtgggaatttaatgggaatttaatgtgtttaaaggttttaatgggaatttaaggtaatgggaatttaaggtttttaataaagggtttgaaattggtataaatataagaaataattgtttttttatttttatttttaattgtggttggttaaattttttttttttattttttatggagattttgaaaagtttttatagtttttggttattaaaaagtatagtttaaaatgttaatttttagttttataattattttttttttttttaaatttagattgggtgtatttagtttaagagagttagtttggaggaaggggtgtggtttgatgaataggggagggaggagagagattggagtagttattttagttgttatttttttggttaatattgattatattgtttgtattataagtagataaatgatagttttttttttggggataagtggggtttttttatgataaaggagattagaggtttttagtttatttgaagatttgttttagtttattttttatttgttgtattgttttgtttggttttgagatagggttttttttttgtagattgaagtgtagtgataagattatagtttattgtagttttaattttttgggtttaggtagtttttttgttttagttgtttaagaagttgggaatatgatatagggttttattgttatttaggttgatgtgtagtagtatgattttagtttattgtagttttaattttttgggtttaagttaatttgttattttagttttttgagtagttgggattataggtgtttgttattatgtttagttaatttttatattttttgtagagatggggttttgttatgttgtttaggttgattttgaatttttgagtttaatgatttttttattttggttttttaaagtattgtgattataggtttgtattattttgtttagttttagtttatttttttttaattatttttgtttttttgtttagtatagtttgtttggtaagaaggttggtgtttggttatatttgtattatttatttgaattaaaagaaggttattgttatttttttatttatattgggatttttaattttttttattttttgtttaaataggtatagataaattagtttgttgtgtaattaatattgtttaggtaattagatattttattttattttttgttagtatttttaatttttaggaatggtttttttagatttttttatattaagtttttaagggaaggatattttaagggaaggagaagggaagaaaaattatagtgttttttgttaggtaaattaatagttgtaatgataattttggtataattttttttttttttaatttgtgatttaattttgttatattttaataagttttggaaaggattttggttattaatgtttagggttttttttagtatgtggagtttttgattttattttatatgtaattttgaggttttaattatttattttgagtgaatgaggaaaagtttgattttatttatttttttttttttagagatagggttttgttatgttgtttatgttgaagtgtagttgttatttatatagtatattatttttataatgtattatagttgtaaaattttggttttaagtgatttttttattttagtttttttagtaggtagaattatagagtttagttttagatttatttatttttttatattaatttgtttgatattggtgggaaaattaatttttattagtttttaatttttgatgtataaagtaggaaaagtaataaaattttttatattaatttgttagtattgatgatatatagaagtattttgtaaatttaaatgtgaatattaatatggaagttaaaataatgtatatttttagaaagtaataagattagatttaatttttaaggattttgtatgtgaagttatttaaatttgtattttaagatagaattgttttgtttattttttttagaaatatttatttttattaatatttattaagttattatagtggtaagtatagtgttaagtattgaattgtatttattatttatttagtttttatagtagttttgagagagaggattattattatttttgttttatatatgagaaaagaaggtttagagtaattaataattttggtttaaggttataaatttagtaagtagagtgtaataaggtatagaaagtaataaatatattgatgtataattaaatttagaaataagttaatatttaattaatttttttagttattttataattagataaatggaaaagttataataattatattaggatttttttatttttttaagttattaatgttttttttgtgtaaagatttaattttaattgaatgattttttttgttgattttttttagtgatgtgattagagaaatttgttataaattatttttttttttatgtaaattgataaaatgttaagaaaaaatagggaagagtgtataattttaagaataaaggtttgtgaatataattaaagttattatgttatttattaataattagtattattatgataggaataaatatatgggggtggggggtatatttttaatagtataatttattttttttaataaatgttttattttggataatagtttttttaatgtattttaaagaaattttatttatgttttttatatttaagatatttatatttatttttagaaaaatgttattttattattattttttgtttttatagttagaaaaatattaatttggttattgttagagaagaaaaattttttatatttttttaggtttagtaattgaggtttgataaattaaattgataaagaatatatttgtaagagaaatgatagatttgatttatatatgtagaataatttatagaaaaatgtgatttaagggggttgtttgaatttggggtatgtgtattattttattaggggaattggaattagaaaagaataatgggttgttgtaggaaaataagtaatatgtaggaaagataaatggatttttaggataatagttggatataggatagtttataataatgtttgtttaggtgtggtgttaaattttttttagtgataagagattattttttttgtttgtaaaatttttaaggaagggatttatgataattggaagttatgataattgagttttttgggggaggatttagttttaggtagataagggagtttaggaggaaaaaaaagttatttttaaatgtttttagattaaaatatatgttttgtttgtttgagatagggttttgttttgttatttaggttggagtgtagtgtaagattatggtttattgtagttttgaatttttgggtttaagtgatttttttattttagttttttgagttgttgagattataagtgtatattattatattttattgatttttaaatttttgtagagatagagttttaatatattgtttaggttggtttagagtttttaggtttaagtgatttttttgtttttgttatttaaagtgttgggattataagtatgagttattaggtttttaaataatttttatgttgtagtagtatattttggatgtttttgttatgaatagatataaatatttgaatatttattttgtataaagtatgtatgtgtattgttagtaatatgaaatattttagtataaaaattaaaggagtgtataataagttgagagtataagataaatgaaatttaaaattttttgttttttaatatttatataatagtaaagaaattttatattatgaatgtttttttagttggtaaattggtaaagataaaaatagattgatatggttgggtgtggtgttttatgtttgtaattttagtattttgggaggttaaggtgggtggattatgaggttatgagattaagattattttgattaatatggtgaaattttgtttttattaaaaatataaaaattagttggatatggtgatgtgtatttgttgtttgagttattttggaggttgagttaggagaattatttgaatttgggaggtagaggttgtagtgagttaggatggtattattgtattttagtttggtagtagagtaagatttggtttttaaaaaaaaaaaaaaaattattttggttaatatggtgaaattttgtttttattaaaaatataaaaaaaaattagttaggtgtgatggtgggtgtttgtatttgggaggttgaggtaggagaatggtatgaatttaggaggtggagtttgttgtgagtagagatagtgttattgtatttttgtttgggtgaaagagtgagattttgttttaaaaaaaaaaaaaaaagattgatatgattatgttgggaggagagaatatatttaaatattgttggttggaatatgaatggttatgaagattttgtagggtggtttggtattttttatttaatttgtatggttttttttatagtaaatgtatttttaagaatttattttataaaataaaaatagttttaaaggatatgtataaatattatagtatatttgtaatgtaaaagaaaaaaatggaaataatttaattatttattaatatgaaattggtaagtaaaattaaggtataattagaaaatggaataattgtttaattattataaagaatgagatgattaaggttgtgtataatattttatatttgtaattttagtattttgggaggtttaggtgggaggattattttagtttaggagtttgagattagtttaggtattatggtgagattttatttttatatatataaaaattttttaattagttgggtatggtagtatgtatttttggttttagttatttaggaggttgagatgggaggattgtttgagtttaggagttggatgttgtagtgagttgtttgtattatagtattattgtagtttgggtaatagaataagatttttttttaaaaaaaaaaaaaagaatgaggaaattgaaatttattgatataaaaagaatttttttatatatttagtgaaaataaatttaaagataaggatgtattgtatgattttattttaggaaatggggatagaaaaaaagaaagaaggtaatagaaaagaaaattttttttagttttatatttttaatagtggtaattttggggtataggtgaagtatgattatagaagatttttattattttatttttgtattgtttgaaattttaattataaatatgtgtaatttttgttaatagaaaatatatagttttatggtaatatgtagttagggaaattatattagagttttattatgtgtattagtatattaaaagttttgagaaggtttgtagtaaagaaatttaatatattaaaagattatttttaaataatgatgtagtaaagagttaattatgaggtttggattattgaggagggttttataggagagagaggaatatttttttttttttttttttttttttgagatagagttttattttgttgtttaggttggagtgtaatggtgtaattttggtttattgtaatttttattttttaggtttaagtgatttttttgttttagttttttgagtatttgggattataggtgtgttattatatttggttaatttttgtatttttagtggagatggggttttattatgttggttaggttggttttgagtttttgattttgtgatttttttgttttggttttttaaagtgttgggattataggtgtgagttatagtatttggttaaggatttatattagattttaaagtattttgatgggtaaagaattagggaaaggaaagttaaaggtagtattgtttaatatgatgtgtaattttaaattttttagttgttatatttaaaaagtaaaaagaattttgtgaaattagttttgtttttttaattgagataaggttttattatgttatttaggttggttttaagttgttgggtttaagtaatttttttatagtgttgggattataggtatgagttattatgtttggttaaaattagttttaatatatttttttaatttaatgtatttttaatagtattattttattatataattaatattttaaaagtataatgagatattttatattttttggtattatttttaaaatttggtatgtaatttatatttagattagttatagtttaagtttttaatagttatatgtggtagtggttatttattgtagtggatagtagaggtttaaggattttgaatttaaatttgaattggatatttatgtgatttaggttgataaaatagtaggaaaggaagtaaagtagaaaaggttgatttggttagagtaggagattagtttaagatattttggattttttattgtaagtaaataagaaaatagggaaaaatatttaataaatagggatgatgattaaagtagtattttagaaagattaatagtttttgttaaaatatatatgtataattttaatatgtaattttttttttatatttttattaaataaaagattataaaatgaaggaagaataatttgttatttagtgattatattttattgatttggtatatatttaagatatttttgaatagttattattgaaatatttttattttatgatatttttaaatgatttttgaaaaatgtagatattaagagttttattaaaatttaatagtttttattttaatattttttaataagagttttttttagttaggaatttaaaatatttttatatataaatttaaaatatttaagattttatatttttgaaatatattataaagtattttaattattagtaagaaaattatttataaattttaatatatataaaatagtattaaaattatttaagttagttagatgtggtggtttatgtttgtaattttagtattttgggaggttgaggtgggaggattatgaggttaggagattgagattattttggttaatatggtgaaattttgtttttattaaaaaatagaaaaaattagttaggtgtggtggtgggtttttgtggttttagttatttaggaggttgaggtaggagaatggtgtgaatttgggaggtagagtttgtagtgagttaatatgtgttattgtattttagtttgggtgatagagtgagattttgttttaaaaaaaaaaaaaaaaaaataattatttaagttttttatagattttttatttttaaaattgagagtttatttttttaatattttgatattttatttaaaggttaaagaaaaaaaaattaatgtttaaaaaaggaggtaagaaagtaggatatgggaagggtattgtaggtataagttatattttttttggtatttgtaaggattgttaaggttggtgtgattttttagttaaaagttagaagtttagtgatgttattaggattaaaagtattatatgatttttaattttggtagttaattgtgttgtaagttaagatattttttttttttttttttttttaagtagaaaaattattttaaagtttattatgttttttttattttttaagataaagaaatgaagatttggattgggttagtgtggtatttgtgattgaataggtatttagtagtaaaattagtattagatattatttataaaaaattagaagttgaaatttaattattttgttgtttttttatggttttttatattttttaaattatttataatagatgtattgtttttaaaatttttaaaaagttgtaaaaattgtttattttattgaatatttttggttgggtgtagtggtttatgtttgtaattttagtattttgggaggttgaggtgggtggattatgaggttaggagtttgagattagtttgattaatatagtgaaattttgtttttattaaaaatataaaaattagttaggtgtggtggtttatgtttgtgattttaattatttgggaggttgaggtatgagaattgtttaatttgggaggtagaggttgtagtgagttaagattatgttattgtattttagtttgggtgatagagtgagattttgttttaaataaataaataaatattattgaatatttttaaaaatagtttttttgtttttttttgtttaaggttttattttgtgggttattttttttaggaaagttttttaaagtatttgtattttgaatagtttagttttttttattagttttgtaatattttttggattttttttttgtagattttaatataattataattagataattatttaatgtttattttttttatttaggttttaagttgaaattttttaagattggttaggtgtagtggtttatatttgtaattttagaattttgggaggttaaggtggaaggattatttgaggttaggagttgagattagtttggtttatgaggtaaaattttgtttttattaaaaatataaaaaggagttaggtgtattggtgggtgtttgttaaatttagttatttgggaagttgagttaggataattatttgaatttaggaggtggaggttgtagtgagtttagattgtattattgtattttagtttgggaaatatagtaagattttgttttaaaaagaaagaaaaaaaatttttaatgttgttttaggttttttgttagattatataaggagtttttgatatgaggtttataatttataatttgtaattttataatttataatttatgtttttttttgttagatatatgtatttgtttgaaatgagattataaaagtgaagaatagaaaagataattttaattaattatattatttgagtatttaggtttagttatgtttatttttagattttttaatattatgggggttagtggggagaagttttttttttttttaagttaatttgagttagggttgttatttgtaagtaagagttatttgagagagttatttaatttttattgttggaatataaaatttatatagtaatgatttttaaatgtttatttttagtataaatttttgttaaattttagatttatatagataattgttaagtggaaatttttatttggttgttttagatattttaaattttatgtgatttaatattatttttttttataaattagtttttttattttattttttatatttgttatttatatttattttgttttttaagttagaaatttaggagttgtttttgttaattttatttttttttttatttatgttagttattgttttttatttattttaggttttaattatttgttattattttaatttatttatgtttgaggttgtaattttttgaatttttgtaattagattttggtgatgattttgagtaggatataaataatttttatgtgtttagtgttttaatagtggaatattaggtataaatgggtttaatttgggttaggttagaaagatttttttataagtttgaatatttttagtttttttttttttaaaatgattttttaatatgtaattaatttttttaattgtaaatgtgattataatattttatttttatttttagtatatttttgtttttttttataagttaatagttaattatatatagttggattaagagttaagttttattgttttagattttaatagtataataaatttgtgttataagaaaggaaggtttattagaaatataaaattataaaagagtaataaagtttataatattagagtaaataaaagatatttaaagataatttatttatttatttaatgtttatttattagttatatattaaattgtttatatgaattggtttagggattataggggttattttgagatggagtttattgattatttgatttttttatgtttttaattagtgttttttttaaaaaatattattggggatttttaggtatatttaagagttttgattagggagagaaatattatttattaattttaagatgtatttattttttatattttagtatttttggaattggggtgtattttataattaatggttttttataattagaagtatattttaagtggtttgtaatattattgtgtattttataatggatataatttaatgtaagttaatatttaattttgtgttaaaaagttggtttaatttggttaatatggattttgtgatgttaaaaagatattttaaagtttaaaaattagtaaaaggtgggaaagtagaaaaggaaaagaaatggtttttattttaaaatttagtgtgataggaaatttatttttttttttttttatggtttgttgtttttaagatttaatagttagattaggatagtttaatagttattgttaggttagataggagtttttttttatttattttttttaatatgtaagaaaagtttgttatagatttattttgtaaattagtagtgaaattaatatttgtataaaaattgttataaaggttagttatagtgttttatttgtgtaattttagtatagggaggttgaggtgagtggattaattgaggttaggagtttaagattagtttggttaatatggtaaaattttatttttattaaaaatataaaaattagttaggtgtggttttagttatttgggaggttgaggtaggagaattttttgaatttaggaggtagaggttgtaatgagttgagtttatgttattgtattttagtttaggtgatagtgtgagattttgtattaaaaaaaaaaaaaaaaaaaaaaagaaagaaagaaagaaagaaagaaaaaataataaggtattaaaaaaaaaaaaaaaaaaaaataggtaaatttgaggtaaatattatagaaaatattttatttaatggaagatttaggaaatttttgagtggtgaagtggtaagaattgggtttatagattaatttaggtagaaatatataagattagataaaggagaaaagtgaaggtaagaaaattataatattagtttaggtgggatgagaatttgatttagagttagggggtgggggtggagttgtggggtggtggggggagaattatgtgaaagttaaataatattagatttgaaaataaatttttgaaaaaaatgtgaaatattaaaatttatatgagaattagaaaattgatataaattaatagttattaaagaaattgaagtgttatttaaagttttttttagaaaaaagatttaggtttaaatggttatataggggaggttttttaaatttttaaggaatagataattttagtttaaaatgattttgaaaaagagaaaaagaaggaaagttgtttaatttgttttatgatttgattattatttttatattaatatgaatttagaattgttttatagttagtaagaatagagagtagaagagttataatattataaagtagaattaatagatgttggttatagataagatatgatgaaatgggaaaaggtttgggtttggtatgatattaataaaaataaagaatattaaagaggtaagtttgttaaggaaaagtagtttagaataattaggtatagatatgtagaaagtaattgaataaaaaagaaaaaataaaataaataaataaaaaaatgtgatttagaagatatataaataaagaattgagaattattttaatagaaaggtttgaataattattttaagggattagagatatagagaaaagtgatttgaaaagtgaaatttggagaatgtatattaaagaggaaagaagaaatagaaggtagaaaagtggtggagaggaataaagttagtataatgttataaaaggtttttttttatttagttaatagttaatttttgtttattttttataatttgtttgggttttaataaagtaattttaaggtattttttttagatttttttattattataagtattagattaggtttttatttgaagtttttataatattttgtattttaattaaaattataattatatttaattagagattttattttttaataagtatttttttattagattttaagttttatgagggaaggatttgttgtattttattgttttggattttgtgttagaatatagtgagtatagatgaatgaaatttaaggagaggtatttgaaaatgtgaagttgatgttaaattttatagaaaatttaaggagaggatttagaaaaaggtagttaaatgtgttgattaggttatagttttttgtgaaggtgaaatttagataataaggggttaagaaatgagtggttagttattaattaggtaaaggtaggaaaagtagattatatttggtaatttttagagatggattgtgaatgattaaattttaattttaatgttgtgttagtttgtaattaataattatgtgttatttttattatgaataagttttttaaaatgttaataagatttgaaaaggaaaagtagtaataagatagtttgaaggagtagtagatttaagaaaaggtttttgtaaattgaaaaaattttaagaatatttgtattttaaagaatttaaatatgatagagaaaataatttatgttttattaagtaggaaaattagaaggaaaggaaaaaaattttaaggtgttaattaataagaaagataaaaaaaaaaaaaaaaattttttttttttgatggaaggttaagaagttagtaatagaaggaatttaatgaaggagtttttgttaagtgttttaattttttttgtaaagggtggggagaagtgaagaaagtagaaaaagtttaaagtgggttttatggaaaatggaggaaaaattaaataagaattgagtttggttttattaaaaatgtattttatattttaattggttttttatatatttattttatttttagattagagaattgtttatattttagttttaaatttaaaaatttaaataattttggtttatattttttattttaataattgaaaataatgagatgtattaagttatattttaatttaaagtttaattttttttataagtaaatataataaagtagttgtttttaattttagtaataaaatagtgataattttaagtaagagtaattgaaaaatgtttttaaatgtaaaagtgtttgtaaatagttttggttttttttttttttaatttgtttgttagaatatgatgtttttgggtttaaattttagtttttttagataagttagttaatttttttgtgatttggtttttttttttaaaataatgaggaatataataaattagaattgttgtaaggattaaatgatgtaatataggtgttaagtttatattatgtattttgaatagtttgttaattgtttaaaagagaaaatttgtaggagtttgattaaattaaaatatttgagagtatgaaagagtattatgtttaaatgttagattttaatatatagtatattattttttttttttgatgtaagtttatttttttttttttgttaaatttttttattaggagtttggaaagagaaaaaagggtttaggtaatttagtagaaagttttttaaaattgaagtatggaattattaggttatggagtggaggttgtgtaggataataggtgaagtagttttgggagtttgggggttagggtttttttttgtggggatttgggggtgggttggttgttttttttatttgatttttgtttgaaatttattttgtttttttttgtttttttttatagtgtttggagttaaattataaatattagttttgttgttttggggtggggaggtgagtgttttttttatttaaggattttagaagtgtttttggagtgatttttgtttattttgtatttttaaatttggtttgtaatttgtgagtgggagataaaagaggggttggtgggggatgtggtgtggggtgttgtgggtttttggttgggtggttttggtttagtgtgtgttgaggtttgtggagttgttggggttgggttgggtagtttttggttttggttattgtgtgtttagttgtttttgtagttttgtttgagtttttttggtttttttgttgtggttagtttttttggtttgtatgtgtatttttaatttatttggattttagggaatgtattttttagtttttggtgtggagtgggtgggtgtggtgagttgttggggtgaagtggggtttgaattggtttttgtttttggtgtgtagtggttttgatttggttgttttttgattgggttgtgtgatttttgttgtgtgtggatggatgtgttgagtttaagtttttttgtttgtttttggtttttttttttttttgtttttgttttttttttttttttttgttaagtttggtaggtggattttaatttttgtagtggttgttgttattgttgttgatttttgttaggaggggagggggtggtgtgggtgtgggggtttgggggaggggtgggtgtttgtgggttttgtatggtgtgtgtgtattgggaaggtttttgtttgtgttgtgtgtatttgattatgggtgtttgttttgttttgttttggatatgaaaagagttgagtgtatggtggaagtgtttgaagagtttgtggagtttggtgtttagttgttggggaggagggttagttgttggtaagggggtgttgagttgttggtgtgggtgggagttggggttgtttttttgtgtgggtttgttggtttttttttataagttagttttatagttgttgtttgggtagttttttgtagatgttgtaggtagtatgtgatggaatgtggtggaggggagtgtggatatggttgttgggtgttgtggttattggtgttttggatgtttgttttggtttttggggttggatatttttatttttgtgggtttttttgtgtggattttttttttggttgatatttatattgtggtgaatgttagttagttggtgtgaaataaggttgttgggaaggtattaagttattaaggtgggggatggttaggttgtggtagttgtgataaagaaaaatataagttatattgtatttgttttttgtttatttattgtttttggtgtttttttttgggttttttgttagtgtgttgaggtgtaggtagggtgatggaggttttttggttgggaggatttgttggggagagtggttttttttattgatttgggagtgttaggtttggtgtgtttgggtttttgtgatttgtgagtttgtgaattttagtggtataagataaggagtggtgagggtttaataggattgaggttagttagttataaatatgtttttagttttattgtgggtttatgttggtgattttgtgtattttttggaggtttattttgtttatttggaaaatgtaaataattgttattatttttttttttttatttttttttatttatggtggaaaatgtttttaaaagtatttgatgatttgtatgtgaggaaagaggagataggttttttttttattaaatgtgattttaatttttttagtaatttaagaaatgtattaagtttaagttatttaataaaagatgtttttttaaaggtgtattttaaaaaattatttttaaaattgggtaaattgggtaaaaagaaagggggaaggaaaataatgtgttaggtatttgtattgatatatatttttgtttgaagaggtgtttagattttagggtatttttttatattttggtataaatgtttgaatttttgtgtattttgttttaattttttggtttattttttattttgttttttttttttttttttatttgtttttgtttttaatgttgtagatagtttttgttattttgaattattttttaattttgtttttttttttaatttttttttttgggttttttagttgttttaggtttgatagttatgggttgtagtattttgttatgtaggaagaagaggatatgtgagattatttgtattaattaaaattggttattttttttttttaagttttttttataatatttagttttagtttttttgttttttggggtttttttgtttttttttttttgagatggagttttgttttgttgtttaggttgaagtgtagtggtgttattttggtttattgtaagttttgttttttgggtttatgttatttttttgttttagttttttgagtagttgggattataggtgtttgttattatgtttggttaattttttgtatttttagtatagatggggtgttattgtgttaataggtgtttttgattttttgattttgtgatttttttgttttggttttttaaagtgttgggattataagtgtgagttattgtgtttagttttagttttagttttaaaggaaaagatgggttttttgtttaaggagatttatattgattggttaaagtttttattgatgtatgttgagtaatgtgttggtagagaaaattatggtaagtgtgttattatgttttttatagtttagttggatttttagatatatgaattggtttataaaatagataataattttaggtgggaattttagtatattaagtttttgaaatgtataaatgagtattttttggtttgtgttatttgttattgtagaaatgagagtaaaattgaagtattaaattttaagttgtgatatgtttgtttttttgtaaaagatttttttttttaaatttttaggaattttttgtttttttttgataaggtttagttagtatttaggttttaatttttagtgttttggttattagtagttagtggggtatgttgttttttttggttattggtatgtttatgtatgttagtttgtttttttggtttgtttgtttagggagatatttggatatgtgtgttttggtttttaaatttaaaagtaatattttgggatttatagttaatattttgtaatgtgttggtatttttttaagtgggttattagaataggttggaaatggtttttttttttgtttaggtaggttataagagaggtagttgttatatgtttaaagtagtatttattaattatattgtgtatttagttatttgtttgtggtttgagtttttttgttttattagaatataaattttatgagtaaaagattttgttagtttttttttttttagagataggtttttattttgttatttaggttggagtgtagtggtatagttatagtttattgtaatttggaatttttgggtttatgtgattttttttttttagttgtttaagtagttgggattataggttagtttgattttgttaatttatttttaattttttttttagagtttagtgtttggtaagtgaatatttgttaaatgagagaagagaaataagtatatatattttttaggtatttttaaattttgttattaagatttttttagtgttagagggtggtatggttattttggaaagagtgaaggttggttgggaaagttgtggattatattttttttagtgaaatgggatttttgtttttagggatttaaggtgaatagattaatttaagttaatttatttaaagttatttttatgttgtaaagattttataaggtaaaaggtagtatgaagtttttgggtttgatgataagttagaggttagtaaggaggtatgagtgaaggaatgttattggtagggtgattttttaggttggttttaaatttaatattaaatgggtaggtgttagggagaataaatagttttattttttagtatggatattattatattttttttttttttttttttttttttggttagtagtattttattatggtttagaaggattaaattgaaatagaaattgtggttaagaataagatggatgtatataatttagtgtataaaatagaggaagtttaaaaatttgaatttatttttattgtggtggtatagtgttttattttttttgtttatttttaaataatttgtttttttttttttagttttattttaatttatttttgttttaaagtattggttattatgattgaaagatagatgatggaggatattgttgtttttatttggttttatttagtttgtggtttttgtattttttttttttttattatttgtatattttttattatagaatttgattttttttaggttttgaggtaggaagaattattagagttttggttttaagtttaagatttagttttttattgttttgtttttttttaagaattgatagttttttttttgtgtttgaaattttgatttgttagtttgttaggatttggaatttttttgtttgttgtttggatttagttgtatttttgtatttagattgttgggtagttgtaggtattgttggtggtattatttaattgtttttagttttttgtttttaggttttttgtatttgtattttatttatttgttgggtttttttttttttattattttaggttggatgtttttatttttattgtgtttttggattattatttgttgtttgtttattattttttggttattaggtattgtttagaggattatggttttttttattgagtattgggagttggggtttttttattttaatttttatgtagtttatagtagattttggttttttttgttttgttgtagtttattgttttgtttttttttatttttatagtatttggtttattgtatttggattattttttaattagatgaaaattatatataatatatatgttttggatatatattaagtatatattaaaggtgtattatatgtaattttggttgggtgtggtggtttatgttagtaattttaagtattttgggaggttaaggtgggtggattatttgaggttaggagtttaagattagtttggttaatatggtgaaattttgtgtttattaaaaatataaaaattagttggatgtggtagtaggtatttgtagttttagttatttgggaggttgaggtaggagaattgtttgttgtagtgagtttagattttgttattgtattttagtttgggtaatagagtgatattttgttttaaaaaaaaaaaagttatatatatatttttttttggttaaaaattaatttaagtgtaataggggtgtgtgtgtatataatttattgaatataatttaaatagatttttagtttgaattttgtgtgtgtgtgtaggtgtttgtgtatatatgtaagtatatgtatatatgtatatatgtatatataaatatgtatatgtgtgtatatatatgtgtgtatatgtgtatgtgtgtatatatatgtgtgtatatgtgtatgtgtgtatatatatgtgtgtatatgtgtatgtgtgtatatgtgtgtatatgtgtatgtgtatatgtgtatatatgtgtatgtgtgtatatgtgtatgtgtgtatgtatatgtgtatatgtgtatgtgtgtatatgtgtgtatatgtaagtatgtatgtatatatatgtatatatatgtatgtatgtatgtatatatgtttgtgtgtatatatataaaaaatttatatatatatttaaaaatgaaaagatttatgtttgattttttttagtatttttaaatattgattttatttaagaatttttttggagttagtagtttagaaatttagtatgtggagttgaatatgattattttgggaatgattagtaaaaggaaggtaaggtgtgatgataaaagatttaagttgagataattggggagataaaatttggattaggagtgtagatttatgaatattatattgtgtttattgtttatggtttatatggtaattgggatgtatttttagatgtggtgtggtgttattagtgtgattaggtatattagtttatttattggatatgttgaaagtatttgattttgtgttggatttaaaagtttagagaatgggaattgttttatttttattttattgtatttagtgtgttgtttggtatattagtaggtagttagtaagtatttattaaatgaatgatatatttaattttgttttttattggtagtttgttttggtgtatttttttttatttttattagttaaggtagggttaggtgttttgttttgttttgtttttttatatttttgaggattaatgataaagtatttattttgttggaatgagagtttattaataaattttgtatattataataatagaattattatttaataatttgtttttaataaataaattttaaaataattttttttattattttaaaggtatatatagttatatatataattagtaattaatatttgttagtgtttattttaaaatgtagattagtttttatttagtttgttatttattttaaagtttttttttttttgattttgaatgttgttagttttttttttaattggttatttttttttttaattaatgttgtttagttgtttagatttttattgtgaaatattagttttattaaatttgaaaatattgttatagagtaatattttgttagattggttttattattttttgaagaatggattatatttattttttatttaatgttatttttttttttatattgtttgagtattattttttttaagaagttatttttgattattttatttttatttttttaggttttttttttaatggtttatattattgattttttatatagtttagttgtttttatgttttttttataaataagtttttatatttttgttttttaatataaataggggttttttagtttgagggagatagtttagggagtattaaaatatatgtagtattaaaaaagtagttttaggttattggagtttattagttattgaatttttgtttttgtgaatttattgttttgaaggttggtgggtagttgtaaattttttgatgtatttgttgtgttgttgtatttttttttttgtttattttttttgtgtatgtattattgttgttatggttatggtattgagtattagggttgttaggttgtataattttaagggggtgttatttgtaatttgtttgatatgaatggtgttttttggaattatgtattgtaatatttgtatgtgattttgttgaatattagaaaattttattttagtggtaatggggaggttggtttttggtttgtttaaagaatttgtttttttattgtgtaatattatatattttttaggatatttgataagatatatttaagtatttgttaattttgtattattaaatatgtgtgtttataaagaaatagattattttgaaataaagagaaaatgttggtagtgttttgtggtggtttaatggatggttattatttttttttataagttttattttttttataatggataatgttatatgttatttttttttttttttttttttttttgagagtttgttttgttgtttaggttggagtgtaatgatatgattttggtttattgtaatttttgttttttgagtttaagtgatttttttgttttagttttttgagtagttgggattataggtgtgtgttattatatttagttaatttttgtatttttagtagagatggggttttattatgttggttaggttgattttgaatttttgattttatgatttgtttgttttggttttttaaagtgttgagattataggtgtgagttattgtatttggtttaatgttatttttataattagaaaagtagatatttttgattgtgggttttagtattaaaaaaaaaaaagagtagatattatttaaaagaattggttgattgatagagagaaaaatgaaagtggtaaattgtatatttgttagaatgaagttagttagaattttatataagatatgtaattaaagtttttatttatttgattgatgtgaatattttttttggtaaaaagagttattttaggttaggtatagtggtttatttttgtaattttagtattttgggaggttaaggtaggtagattgtttgagtttaggagttttagattagttggggtaatatggtaaaattttatttttataaaaattataaaaattagttaggtatggtagtatttgtttgttattttagttatttgggaggttgaggtaagaggattttttaagtttagaaggtagaggttgtagtgagttgtgattatgttattgtattttaatttgggtaatagagggagattatgttttagaaaaaataaataaagagttgttttgttgttatatttgtaataatatattatatttatgagattttaattatgtatattatatgttattaaaattagggtattgttttgttgtgggttttttttatttaaagaatagtatggatattgttgattataagatttattattattttatgtataattaaggaagaaaaattttgttagttaaattttgatatgttaattaagatattgtaattttagaaagttttaaatgttaaaaaaaatgtgtatttgagaattaatgaaatatggtgtattttaatgtatttagaaggtgaagtaatgttatataggttagtatttgaaatgttaaatttttgagtttttgatgtataattttgttatgtttgatttttgaatagttatattgtggatgatattataaaagtagaggtagtgtagtttaattgtatgtaaatatgtaaaataaataaaagtgaataatatgatttagttatataatgtttggaaaaaatattagtattaagttatgtgttggattatattataaattaaaaattaattttttttttttttttgagatggagttttatttttgttgtttaggttggagtgtaatagtataataaaaattaattttttgatagttgtttatattgaaaatgtgtgatgataagatgaattaaattttagatgttaatatataagttatttttggagaagttaaattaaatatttagaaaaattttagtagtgtaatagaatgattttatatttgttttggaaattgaataatagtgtttgttgtttatgaggttattaggaaaagttagttgtggatttttttttagtataattaattgtttttgttgtatataaaattgaaagaattgggtgttttagtgtggaaaaaggatattttgttatattgtttttatttttttataaaggttattattgagttttttattattaatttgtatgtattggattattttgtgatgaaaggttaaaaggttttttatttttatagttttttattttatttatttggtatttttttggagatatttgttttttttttaagattagttaattgttaggatgttagaaggtggttaatgattgattttttttttagagattgtgagtttatttttttgttgttttttggggtggttttttttattgttgagaaatattttgtgttttgttattatttgaggtaaaaaatgttattttttttttttttttttttttttttttttttttttttttttaaagatagagttttgttgtttgttatttaggttggagtgtagtggtgtgattatagtttattgtagttttaattttttgggtttaagtaatttttttattttagttttttaggtagttgggattataggtgtatattgttatatttagttgatttttttgtatttttgtagagatagggtttttttgtattgtttagtttgattttgaattttgggtttaagtgatttttttattttagttttttaaaatgttgggattataggtgtgagttattgtgttaggtttaagattttgtttttaaggttgagttgagtaggttagaatttatattagtattgtttaatagaatttttagtgaaaatgaaaatgttttgtattttttttgttttaatatagtagtttttaattttatgtggttattgagtatttgatatggttaaatagagaaattgaattttgatttttatttatttttaattaatttagaatttatatagttatatatgttaagtagttattgtatgtattagttagtgtaggtttatatgaaggatatataaaaaaattatttgatggttttagtgtatataatgggtagggattgaggggttggtattgaaaatgtagtattttagttaagtgtagtggtttatgtttgtaattttaatgttttgggaggttaaggtgggtagattatttgaggttaggagtttaagattaatttggttgatatggtgaaattttgtttttattaaaaatataaaaattggttgggtatggtgatgtatgtttgtaattttagttatttgagaggttgaggtaagagaattttttgaatttaggaggtagaggttgtagtgagttaagattgtgttattgtattttagtttgggtaatagagtgagattttgttttaaaaaaaaaaaaaggaataaagaaaatgaagtatttaaataattaaaagagtagaattggattgtttgtaatataaaggataaatgtttgtggggtggatattttagtttttgtgatgtgattattataattgtatgtttgtattaaaatatgtattttatttaaaatatatatatatatatatttataaaaattaaaattaaaaaaaatgttattttaaaaaagaaaatgggttgggtatggtggtttatatttgtaattttagtattttgggaagttaaggtaggtggattgtttgagttaggagtttgagattagtttaggtgatatagggagattttttttttataaaaaatattaaaaattagttgggtatggtggtatatatttgtagttttagttatttaggaggttaaggagggaggattgtttgagtttaggagtttgagataagtttgtgtaatataggtggattttttttttataaaaaatattaaaaattagttaggtatggtggtatatatttgtagttttaattattgaggaggttgaggtgggaggattgttggagttagagaggtggaggttgtagtgagttatgttggtattattgtattttagtttggatgatggagtgagaaaaaaaaaaaagaagaataggttttgaaattattggttgaattgatgtttttgtttttgttgttaaaaataaatggtagaaagtttatatatttagggattttttttgtagtttgttattagagaagtttttttaaatatgtagagtattagaaattggggttgttatttaatggatataaagttgttgtttatattaagtgtttttattatgatttttttgtttgttttttgagatggagttttattgttatttaggttggagtgtagtgttttgattttggtttattgtaatttttgtttttagggtttaagtgatttttttgttttagttttttgagtagtaaggattataggtatatattattatgtttagttaattttgtatttttagtagagatggggttttgttatgttggttaggttggttttgatttttgattttaggtgatttatttgttttagttttttaaagtattgagattatagatgtgagttattgtatttggttgatttttttaaaaaaataaattttttgtttgggtatggtgttttatgtttgtaattttagtattttgggaggttgaggtaggtggattatgaggttaggagattgagattattttggttaatatggtgtaattttttttttattaaaaatataaaaattagttgggtatggtggtatgtatttgtagttttagttatttgggaggtaggagaattgtttgaatttgggaggtagaggttgtagtgagttaagattgtattattgtattttagtttgggtgatagagtgagatttttttttaaaaaaaaataaaaataaaaataaaaaaaataatttttttaatggtagaaattagttaaaatgttaagtagtggttgttttttagtagtaggattatggttattttttttttttttttttgtttatgtgtgttttttatattttatttaataagtatatattttttttttaatttgttaatattaaagagagttaaatttatttatttttttattatttaattttaaattaaagtggttttaattaattttttttttaagagagagggtagttattttgaaatattgtttttttaaaaattattttaggtagtaattttagttgagagatttgtattttttattttagtgtgaatagtattagagatttgtgtttgggatgttttagaattttgttgagaagaattagagaatatttttttggaagatatggttgtagatttggagttatttttttatttaggtattttttgggtgttgtgttaggatttaagtatttttggattatattttggagttttagagttaaggtttaatagtttaaggaggtttgtggattgataagggttttggttttaatattgagaagagaattataaaaagaagtttttattttttaaaagtttatatatgattgtataggtttaattgggaatagtgagttgtttatagtaaagtataaattgtataaagtagattttagtggatatttttagaggatgttttgtgaatttttatttttttaagtttagatttagtagagttggtttggtgaggtagggtgttgtaatgttagttagaggagtagtttagaaatttttttttagaattttttttgattaaaagagatggttaaagagtttttttttttttgaaatttgaggttaattttattatttttttaattgtttttgtatatttattaaagagatttttgagaaataggtttagttatatgatgtggtgggaagaatatgaattttgtaattagaattttggttgtattttttagttttttattttgggtagagtttgttagttttttagatttttagtttttttatttataaaatgggaataaataatattaattttatgggatagatgttagaattaattgagatatatgtaaagtgattgttatagagttagtatttaatgaattttagttattttttttttttttttagaaagtgattggtttattagtgtttgtgttgaaggggagagaaaataaattgtaaaattttaaatgagttttattttaaatatagtttaatgtagtttagtaattagtatatgagttttgttttagtttgggttgggttttagttttttattttagttttagttttggaatttttttttttagaaaattttggtggtttatttttaggttgggttagtggtttgttgagttgttttgtagtatttatttggtttttggttttttaaattgaggtatttaatattgaatgtggagtataaaaggttatagagtaggttgggtgaggtggtttatgtttgtaattttagtattttgggaggttaaggtgggtggattatgaggttaggagattgagattattttggttaatatggtgaaattttttttttattaaaaatataaaaaaattagttaggtgtggtggtgggtgtttgtagttttagttatttgggaggttgaggtaggagaattgtttgaatttgggaggtggaggttgtagtgagttgagagtatgttattgtattttagtttgggtgatagatttagatattg

SEQ ID NO: 65 - DNA, 29256 bp, Artificial Sequence
  chemically treated genomic DNA (Homo sapiens)
atgtgaaattaaagataaattaaggagttaagttttaaagaattagtataagttgtttttttagtaaagaaattaaagaattaatttgaagtagaaagaaattttttgaatttgtaatgtttttttagttttaaatttttattttttggtttttggttttatgattgtttatatattttaaatattataaatgttaagtgtaaatataattttatataaagttttattgtatagaaaatagagtatggttaatttaagggggttatttattttatttgatttattatttattttgggggttggttttaatatgtgtagtgtatgtttgaatgttttgtgttaattttattgataatttttgttgggattagggaatattgtgaataagtaagtagaaaatgagggttgggtgtggtggtttatatttgtaattttagtattttgggatgttgaggtgagtggattatttgaggttaggagtttgagattagtttaattaatatggtgaaattttatttttattaaaaatataaaattagttaggtatggtggtgtatatttgtaattttagttatttaggaggttaaggtaggagaattgtttgaatttaggaggtagaagttgtagtgagttgagattatgttattttattttagtttgggtaataagagtgaattattgttttaaaaaaaaaaaaaaaaaaaaaaaaaaatgagatttgttattatttgtaagatttgtggttagtttggtattatattttttatatgttagaaaatatgttttaataaatatttgtgaatgaatagttattttatttgttatgttttttattttaatagagaattattagattaaattttttatttttttgatttataagattttgggtatatttaaaaaaaaataatatatttagaagttttaagtttgttgttgaaataagtattggaaaaaataagtgtgttattaagtattatttatttataaatgttaatatttttatttttaagtaattttgaatgtagttttttaattagaaatttaatataaatgaaaaatttttttttatagtttattttgaattgttgtatttatagaggtagttgtttagttttaattaatggtatgggaaaaataataggaaaaaaattgaaattgtatgttttttaatgtgatagttttaaattgatggagtaagttttttagagaaagtatttttaaagtgtattattggttgaggtaagaatgttgttattgttttttttttttttttttttttgtttgtagttaaattaagatttgagaaataaggttttattaaatagttgttttagaatttttagttttattaaagtttagatataaattatatttaaaagtttttataatgaaaagttttttataaatattgtgggggttgatttaattattagaataaagaagattatattagtgaagtaaagaattttttaaattttttataattaggagaaattagtaattggtaaatatatatatatagatatatttattataattaattattattattgttattattaataataaattgtaaattatgattatgattgtgaaaaaagtaaaattaatgttaaagtttttattggtttaaggtgtattgttgatagtatttagttagtaaagttttataattatgatatttatttagattgttatgttaaagaaaaggggtttttattttattttttgggagttttttttttttttgttattggttaatttttgtttagtatgttttttttattttgttttatttttttttattttgaggtgtttgaagagtatgattttagagggagttatttagtaagtgttttttagttttagttttttttattttgtagtttttatgatttaataagaagttgtgtatataatttttaatttatagtaaattgagtttttgtagaaggattttaattttttttttagaagttttaggataatttttgttgtttttttgtagttttttttaaagaatttatagtttggtttatatgggagtatattttgttttgatttttttgtattggtttttttaaagttagagaatagaattttttatagtgttaggtatttatttaatgtaaaaaatattgtagaattgattttttttttattttttgtttttttttaattgtttttttgggattatatttattatgttaatgagttgtattttagatatttgtgaaaagattgattaatttagttggttgtattttaaaagttttagagtttgttaattgagattagtttaaggtttttgaaaatatatttgttttaaagattaaagattaaaaattgttataatttgttttggtttaatagtggtttagagtgtaggttttggaataataatgttaattttgggagtttggagttgttattgatagaagatttagtgtaagttatttaatttttttattgtttgttattttttatatgtgttaagtgtttggaagagtatttgttttataataagtttttaattatttggagtaaatgtaagaaaatttaaaagttagattttttgttagtttttatggttatagaagggttttattatgaattaagttgataggagttaaaggaatttttttaagttatttgtatatgaaaaatgggatttttagtggtttttattttttttattttaaattttaaaatatagttgaaattgtttatgttaataaaattttatgaaatattttatatgttgaagagtgattaaaagaatttgtttttaagaaaaataaatttatttttttttttattttttttttttatttattttttttttttaattttaaatttaaaaaattataaagattgatgtattaattgtttagaaaaagtagaattttttatattttggggtgattaaattttatttttggttttggaggattggtagagagatttgatttaattattaagttggggttgtaaaaaagttagtttattagggtattttatttaagtatatttgggaagtaggggtttttaatttatattatagattgttagaagtaaggataagataaattagattatttgggggttgaaaaaaatgatggttgaatatttaatttgtgaaatttggtagtggatttgaataaatttatagttggggaagttagttaaattggtttgggaaagggaatagtagaaattttgtagtggtagttgatggttataagatgttattttatatgagtaaaaatgtttgttataaggtgtttggttgtaggtgattgaaggtgtagtgatggagaattgatgtgggtgatttgttttttttaatattatatattttttttgatggttgatgtagtgtttttttgggagtattttttgttagtttggttagatggttttttaaggtgttaggagggtttgaatttgagtgtggtttttttgtatttttgtgtttggggttaatgatggtttgggagtgtgggtattgtttttgaggttaggggtaggaggattggtggtttagaagtagaggggtttgtgggagagaagagaatagaaaattttgtagatgtgtggtggtttttttttttggtgtttgtttgttgtttttggttggaggttagtaaggttagtaggatttattttttgtttgtgttgtggttgtggagttttaagtgagttgtgttagttttgtggttggttagtgagggggtgagtggtggatgtagtgtggtttgagttttttgagttagttattttgggttgtgttttttatgtttatttttttttagatggggtgagtgggtgttgtttggtattgaagttgtagtgtgtttatttgtattggttgaatttggtgtatattgtttatttggtggggttgtttttgtaggtttttatgatggtttgtattttttttatattgattttattgttggtaaagagttggtgtaggatgtggattagattagttagggtttgtggttttagtattttggtttgttttattttgtggggagttggttgtgtgtgtgttttattgttgggttgtggtggaggagttgagtgagttaaggagttgggggtgagggagtttaatagtttgttagattgttaagtagatatatatgtataaatttagtattagagtgttgaaatgtaaggatgttgttgtagagatagtaagagatttatttttaggtttttggtagtgtagtggatttgggattgttggagatgtggtgtatatataaattaggtttagatttgtggggtttatttttttgggttttttttaagtgtttggagttattaggaatgtattaatggtttttggagggaggatgaggtggagagttatttaagaaaggtggtggaggtggggagattttgtgggtatggtttatgtgtatatttttggtttttttgggttttgtgtttttttaagagttttgttgtttttggtgttttagggattgtgtgggttttgtgtaattttttttttattttaatggtgtgttttagttgtttggtttaatgtttttttttgttttatttttgttgttgtggtttgtgatgttgggatgtagataaaaagggttggaggagatggttgtggggattgatgttgagtaaaggaggaaaagaaaagggaaggagagggatattttttttaaatagagaattgtgaggagtttgtgaaaattgaggatggattttatttttaggttagagagtgtttgttttgttgattgaaattatttatgatatgttttaggttaggtgaaaataagtttaagattttatatatatatatatttaagtatatatatatatatattttttaaaatgtgtattgaaatatattttgataaaggagatttgggtttttagtaagataattagtgaaatgatggaaaattaagaattttttgattttaaaattaaatatttttttttaaaaaatatttagtgtaaataatttgatattttatttgatggtgtaaaagggggttttttttgaggggatagggtgggttttgatgtaataatttaagaggttataattatatttgaattttttaattttaggtatgtgtttgaaggagtttgttagtatatatatataaggaaatatgtttttatgttatgtatagtatttagtatgttgggaataatataaattaagtatagtaggatttaaatgagaaagatgtgaaaggtggaagaaatgtaagtgtagatttttttttttttattatggatggatgtagggaataatttggatttaaggttattaaagttttagatttttgaagatttgtttttttttagattatgattatttttttttgtgtatatatatgtatataatgaaatttatttgtgttaggtagttttaaatatttttggtaaaatttgttatattatattttaatagtgttgttaaaagtggaattatttattgtttaaaaatggttataagtagaaagtattttagaagttagttttggtgatgtgtgttgttgtggggtagtgaattaataaagtattttgtgatagagtaatttgtaaattttttatggtttttttaaattattttttatttttggtaatgttttttattgagttttttaattattttattttagttagtttaatttataaatgtttggaatgaataataaaaatgaaatgtaagtataatttattttttttgtattttagttgataaaatttttaaatttttttgataatttattttttttttttgatttttttttttttttttatatttttatgaaagtaatatatttatgtagttaaaaaaaattaatagtattggaaggttaatgaaaagtagtaggtttttttaattatttttgattatttgttttgtgtttaaagagttagttttttaatttttttaattattttttgtggtagttattttttttttttaaaaataggtttatatttttttttgttttagtaattttagatattatttagttattttatattatgatagttttatttgtttattatttatttattaatttatttaataaatgtttttttgggtgaatagaaatttttattttatttgagtaaatatttaggagtgagattgttgggttatttagttagtgtatgtttaaatttgtaagaaattgatatattaatttgtaaagggtttgtgttattttatatttttaatagtgatgtatgagttttagttgttttgtatttttgttaggtattgttagttttattaattttggttaaatagaggtgtgttgatattgtattgtgttttttattttttatatttttaatttttatgggtaggtttttgtttttagagtttttaagatggtggttattgtttttaggatggtagtaagttttttgttttttgaattggggtttttggttttatggattttaaggaatggaattttggattatgtggtgagtgttatagttttattagaagttgtgggttatagaagagaattgtggaatttagttattagtgtttagtttaaataggatgaatttgggtatttagttatgtaggaataatggtaagtttttagttggattgggagtggtaatgggtgttttgttggattagtaaagtagtggatattttgttggatttggaggggtggaagttggtggtgggtttgtgatagtggtaaatagtagtggtgaaaagtgagtgaaagtttagtttgagttataataaatatagattagaagagtgtgtagttgttagatttaatagagtgaaaatatagtttttatataatgtgatggtatgtaaagagggttgttattttttgttttaatgtttgggtttatatttggattattgttttttttttatgtttttaggtgatatattatttgattatttttttattttttgttttagtttaatttgtattttagtgagttttttttattgtttgattggttgggtgtgagttgagttataagttttgtgtttaaaagtagttgtagttattttttttagttagggtttaggaatttttagttggtttaggaaatttagtttgttttgttttttataatgattaatgatgttgagtatatttttatgtgattagttatttgtaaataatttttggtgaaatatttaagtattttgtttttttaaaaatttaattatttgtttttattgttgagttttaagagtttattatatattttagaaataagttagatgtgtgatttgtatatatttttttttagtttgtgattggttttttgtttgtttttttggataaaggttttgttgtgttattgaggttggagtgtagtggagttattggtttattgtagtttttaatatttgagtttaggtaagtttattgtttatgtttattgagtggtagggattataggtgtgtattattatatttggttgattttttatttttttgtagagatgtggttttgttatgttgtataggttgggtttgaattattaggtttaagtgatttttttgttttagttttttgaagtgttgagattataggtatgagttattgtatttattttttttttaattttttagatttaggggttatatgtgtaggttatttgggtatattgtgtgatgttgaggtttttggtataaatgttattgttatttaggtattgagtatagtatttaatagttttaatttttttttttttttattttttttttagttatttttagtgtttattgttgttatttttatgtttatttgattttattttttgatttttaaagattttaaggaatttttttaatatattgatattgatatatttttattgtttttttttttaattttttttttttttttatatttaggattttattgattgtttgtatgtggatgttatttatatttttttagttttatatgtagattgtaatttttaatattttttggtatttttgatgtagtatgtgtgaaattttttttaagaatgtttttttaaatttttaaaggttttatttttgtaatgaggtatttaggtttaaaaattttatttattgttgtttattttttttttgtattattatttagattttatttaattaattgttaagttttgtatttttttattattttttttattttgtatttttattgttattttattatttaaatttttatttgattttggttggattatggtattggtttttgaaatggattttttggttttagtttttttttatatgtattttttatttataattgtttgattttttagtttaaagtatagaattgatgatgttgttttttggttatatttttttaataattttaatttttttatataataggttttattaggttggtattaattttttttttatattttggttgtaaattattttttttgatattttgttttttattatttttttttatgaatatattttttagttaaattgaatgtgtttattaaatttatttttttgtttaagtttttttttttgtttaaattttagttagttattttaatatgttttaattttattttaagatttagtttttatttttttgttaaatgtgttattttttttttttttgaataatggaataattattattttttttaaggtatttattattttttagtatgtattgtaattatttatgtggattattttgatagtgagaatttttaagataggttttttttaaattttatttttatattattattagggtttagtatatagtattttgtgtaggttaggtataaatagaaatattttttaagtgtatgtataaatgaaattagtaaaagtatattggttagagttttttaatattagagttattggttagtaaaagtatttgtttagttttttatttttttttaaggattttagggttgtgattttaaatttagaaaagattttttttaggttttttgtaaaggatatttgaattttttttaatagtgttgtatattgtaatttaaatgtagttattaaaaaaagttgatattatagattttattaatataagtagaatatttagatttagagaggtagttttattgtattttgaattgtttagggtaattaatgattgttatatttttagataggtattgatatggtggtagatataaagagaagggaattatttaatatattttaaaaagtatgtattatatgttaggtattgttaataaaattaagttattgtttttagagggtttatattttaatggggttgggttggtaggaggagtatattaataaatattgtatatagtatatatggagaaatggatatataaatatttgataaaatatataatggagaaaaataaaataggggaagttgggtaagtagagtggtgagttgttgttttagagggagtttaggggaatatttttttgaggtggtatttgagtgaggattgaaggatattagtaagatatttgtttagggtaagtttttaggtggaagaattagtaagtgtaatagttttgggattgtagaaagtttagtgtttgagtaatagtatttgggtggtagagtgtggggaagtgatgattatatattatataggttaaggtaaagattttagtttttatattaatatagaaagttattggggattttaggtgaggagagagtatatatagaggaattaatgagttagttgttgtaatttgagtgaaaaaaaattatgatggtggttttgtttatagtggtagtagataagaaatggttggattttgaatatgttttgtaggtaaattagttaggtttttaaatttttatggatatataaatgtatatatatatggggtatatgtgaaattttgatataagtatataatatgtaatgattaaataaaggtaattgaaatatttattattttaagtattttttattttttgtgttatgaatattttaattttatttttttagttattttttgaagtatatattattaattatagttatttaattgtgttatttaatattagatttttttttttttaattgtgtattttttttatttattaattaattttttattatttttttttttttattattttttttagtttttggtaattattatttatattgtatttttataaaagtaattttattttaagttttgtgatagaagtgttgaatgtgtaggtttgttaaataggtatatatgtgttatagtggtttgttatatttattaatttattatttaggttttaatttttatatgtattaggtatttgttttaatgttttttttttttttgtttttaatttatttataggttttggtgtgtgatgtttttttttttgtgtttatgtgtttttattgtttattttttatttatgagtgagaatatgatgtgtttggttttttattatagtgttagtttgttgaggatgatggtttttagttttatttatgtttttgtaaaggatataaatttatttttttttatggttgtatagtattttatggtgtatatgtgttatattttttttatttagtttattattgatggaaatttgggttggttttaagtttttggtattgtgaatagtgttgtaataaatataagtgtgtgtgtatttttatagtagaatgatttataattttttgggtatatatttagtaattggattgttgggttaaatggtatttttggttttagatttttgaggaattattgtattgttttttataatggttgaattaatttatatttttattaatagtgtaaaagtgtttttatttttttgtatttttattagtatttgttgtttttaggtttttttaatgattgttattttaattggtgtgagatgttagtttattgtggttttgatttgtatttttttaattgattagtgatgattagtttttttttatgttttttggttgtatatatatttttttttgagaagtgtttgtttatattttttgtttattttttgatggggttgattttttttgtaaatttgtttaagttttttgtagattttggatattggatttttattaaatggatagattggaaaaatttttttttattttgtaggttgtttgtttattttgatgatagttttttttgttgagtagaagttttttaatttaattagattttatttgttaattttggattttgttgtaattgtttttggtgttttagttatgaagtttttgtttatgtttatgttttgaatggtattgtttaggtttttttaagggtttttatagttttaggttttatattttagtttttagtttattttaatttttgtataaggtgtaaggaaggggtttagtttttgttttttaaatatggtgagttagtttttttagtattattattatttattaaatagggagttttttttttattgtttttttttgttaggtttgttgaagattagatggttgtagatgtgtggtgttatttttgaggtttttgttttgttttattggtgtatatatttgttttggtattagtattatgttgttttgggtattgtagtttttgtagtatagtttgatattaggtagtgtgatgtttttagttttgttttttttgtttaggattgttttggttatatgggtttttttttgggtttatatgatatttaaagtagtttttttttagttatgtgaagaaagttaatggtggtttgatgggaatagtattgaatttataaattatttggggtaatatggttatttttatgatatggattttttttatttatgagtatggaattttttttaatttgtttgtgtttttttttatttttttgagtagggggttttgaaggttttttatgttttttgtaaggtgtatttttaggtatttttttttttttttgagatggagttttattttgttgtttaggttggagtgtagtggtatgatttgagtttatattgtaagttttgttttttgggtttatattatttttttgttttagttttttgagtagttgggattataggtgtttattattatatttagttaattttttttatttttttatttttagtagagatggggttttattatgttagttaggatggttttgattttttgattttgtgatttgtttattttggttttttaaagtgttgggattataggtaagagttattgtgtttagttaggtattttttttgtagtaattgtgaatgggagtttatttatgatttggttgtttgtttttattggtgtataggaatgtttgtgatttttgtatattgatttttagttttgaatatttttgttaattttttgttttgttgatttaatattgatagtggtgtgttaaaattttttattattattgtgtgggagtttaagttattttgtatgtttttaagaatttgttttatgaatttgggtgtatttgtattgggtgtatatatatttaggatagttagttttttttgttgtattgatttttttattatgatataatgtttttgttttttttgaattttgttggtttaaagtttgttgtattagagattaggattgtaatttttgtttttttgttgttgttgttgttttttatttgtttggtaaatatttttttattttattattttgagtttgtgtgtgtttttgtatgggagatgggttttttgaatatagtatattgatgggttttgattttttatttaatttgttagtgtatgttttttaattggggtatttagtttatttatatttaaggttaatattgttatgtgtgaatttgattttgttattatgatgttagttggttattttgtatattagttgatgtaatttttttatagtgttattggtttttatattttgatatgtttttgtagtggttggtattggttttttttttttatattttgtgttttttttaggagtttttgtaaggtaggtttggtggtgataaaaattttttagtatttgtttgtttgtaaaggattttatttattttttatttgtgaaagttagtttggttgtatatgaaattttgggttgaaaattttttaatagtgttgaatattggtttttattttttttgggtttatagggtttttgtagagatttattgttagtttgatggtttttttttgtaggttatttgatttttttttttgttgtttttaatattttttttttattttaattttggagattgtggtaattatgtgttttggggttgttttttttaaagagtatttttgtggtggtttttgtattttttgaatttgaatgttggtttgttttgttatgttggggaagttttttttgataatattttgaagagtgttttttaatttggttatattttttttattatttttagggattttagttaattgtaggtttggtttttttatatagttttatattttttggaggttttgtttattttgttttaatttttttttttaattttttttttatgttttattttagtaagttgatttttaatttttgatatttttttttttattgattaatttggttattgatgtgtgaaaagaatttttgtagttagtttggtgtttgtttgaatagttgtttagttttgtttttgaaatttagagttttgggggtgtaggtatatgagggaattttttggtttgtggatttttaaaattaggggaaaagtgtggtatttgggttagataatatagttttttatagttttttttggttgggaaaagtaggtttttttgttttttttattttttgtatgaggtgatattttattttgtttttgtttattttttttggttttatttattgtttatttagttttaatgagatgaataggatattttagttggaaatgtagaaattatttatttttgtatttattttatttggagttgtagattggagttgtttttatttggttattttgttagttaattttaaaagtattttttttttaggtttttatatatgagagtatgtgttatttgtttttttgtgtttggttttttttatttaatattataatattttttagttttatgttgtaaataataggattttatttttttttagggtttaagatgatattatgtatattttttttatttattgatttatgtatggatttttaggttgattatgtattttggttattgtgtatattgttgtaatgtaggtattttgatatatagatttttttatttttgggtttataattagtagtgagaatgttggattatatagtagtttttttttttattttttgaggaaattttatatttttttttttagtagttttagttatttatatttttattaatagtgtataagtattttttttttatatttttattagtatttattattgtttgttttttggataagttatttaaattggggtgtgatagtttatttagttttgatttgtatttttttggtgattagtgatgttgagtatttttttatatatttgttgtttgttttgatattttttaagaaatatttatttagattttttgtttatttttaatttttttttgttattaagttttttatatatttgtttttaattttttgttagatgagtagtttgtaaatatttttgtttattttgtagtatatttttttattttgttttttttgttgtgtagttttttagtttgatgttattttatttgtttatttttatattggttgtgtttttgaggttttataagaaatttttgtttagtttaaatttttggtttttttaattttttttttataattttaagttttatatttaagtttttaatttattttgatttttgtatatggtgagagaggggtttaattttatttttttgtatttggatatttagttttgtttgtattatttattatagaagagattgttttttttttaatgtatgtttttagtgtttttgttaaaagagttgattgtaagtaaatatatggatttatttttgggttttttattttgtttttttggtttgtgttttgtttttatgtttttattatgttgtttttgttattatagttttgtagtatataatttgaggtttagtaatgtgatgtttttggttttgttatttttgtttaggatggttttggttgttttgggttttttgtggttttatataaattttagatttttttttttttatgttagtgaagaatgttattggtattttggtagtaattgtattgaatttgtagattgttttgggtagtaaagttgatggattgaaattgggttggaagagagttaagattttaagtaattatagggatggatttattatttttaagataagatttgggaaaagtggggtaggaaagggggaaaggtatgttttgtagatgtagataaaagaattgggaataaatatttggaggaagtaaggaggtagattttgttatgttgtaagaaaggtagttatgaaataaatagagttattttaaaatggataggatattttttttgtttattattagaagtaattaatttagatttatgtgtattagttatgatagaaggaattatgggaattgatttataaggatttttttaaagattttatttatgttttattttttattaatattaaatatgaaaatatgggtatagtagttagtattaggtattaaattattttttattatttttaaaaattttattttaaaaatttttgagatttaaatttaaatttgaaaatttgttttatttttttgagttaatatgaaagtgattttaagaatagggattttattagttttttatgagttttattagtgttattttaatatttaggatatagtaggtatttaatatgtgaatgataggttatatgaataaattgaagtttatatttatgttttaaggtttttgatattgttaaatggttttttaaaagtgatatattaatttatattttatttattaaaatatgataggatttttttataattttgttaatagtaagatgtatattatttttattgttagttagtattgtttttatttgtattttttgtaattaatggggtttaaggtgttttatgttttgttggttatttgtatttttttgtgaattgaaatttggtatgttttgtttattttttagttggtttttttttattaattgaaataaattttttatatatttaagatattaaaaatattgttatatgttgtaaatattttttattattttttgttgtataaaaatttaaattatataaaattttttttgtttttagttgttatattttgttaattataattttatttatttgatgtgttatattattaattatttatatataaggaaatgtattaagtattatgtgtgtgtgggtattagataaaaattagaataattggatatatggttttgaggtagtatgtaataagtgatttaatagtggtagtttgttttaagtgtttttatgagagaaagggtattttttttttgaatgatttagatagtttttaaaaagttaaaatttgaattaggttttgaagaagagttaggatttgaaagggtgaaggtgtaagtaaattgtatgagtagaagtagataatagaaaatataaggtatttttaaagaatggtgaataatttagtttgggttaaataatgtaggtagagtatttatataaatatgatttgaattgtatttaaatagtagtatttgttgaattgttttttgaatagtttttattatgtggtttgtagttggtttttttagtgttaaaagtttatttagtatattataatttttggaaaatgaagtagaaattgtatgaaaagagatttttatttttatatttttttaatatttaaggtttttttattttgtgttataattaaattggttgattaatgttatgtaatttgagaaatatattgtattttgttttagtagatatttaaggtttttttaggattgaaatttatagaaattagattttaggaattatttaattttattttgattttggataaatattaatttgttttattttttaaatatggtgaatttattatgaagtttttggtatatttttaaagatggaagtataatattgtaatattatatatatattttgtgtgttatgggttatttatgtatagtaagatgaagtatgatattaatgatatttatttagttataaagaaaatttaaaatattatttgaatgtttagttttttttttaagtttaattagatttgagagtttaaattaaaaataaattgtgttgtaggttttagttatttaataatttattggatttaggtttaattattgtttaatgttgtaaatttagtgtagaataattttttgagtaaagattaagaaataattaaatatgatttgaaaaagtataaagtttaggtttggtatggtggtttatatttataattttagtattttgggaggttaaggtgggtggattatttgaggttagttaggagtttgagattagtttggttaaaatggtaaaattttgtttttattaaaaataataaaaaattaggtgggtgtggtggtaggtgtttgtaattttagttatttaggaggttgaggtaggagaattatttgaatttgggaggtagaggttgtaatgagttaagattgtgttattatagtttagtttgggtaataagattgaaatgttgtttttttaaaaaaaaaaaaaaaaaaaaaaagtgtaaagttttatgtattttttagagttgttaggaaagaaaataaataaggttagttatatatttagttaattttagatttaataaattattaagttatttaggttaaaaagaataattaaatggatgttataaattttaattagtatttttgattttttgaggtttattatttgaatttttagtggtaaataatatgaaaatttaatatatttttatttgttaaatatatgaatataattaaatatatttttttagtaaattgaattggataaaattagagaatagattttttttatatttatttaattttaaaatgatattattttgaattttattatatattattttagattttgttttgaaattttatttatattatatttgatttattagaatgttttttttttttttttttgagatggggttttattttgttgtttagtaggaatgtagtggtataattatgatttattatatttttgaatttttgggtttaggggatttttttgtttttgtagtttaataatttttttttaatttttatttttttgtagagttggggattttgttttgttaattaggttggttttaaatttgtggttttatgtaatttttatattttagttttttaaagtgttgggattataggtgtaagttattatgtttgatttggaatgttttttaaaaatatggtattataaatataatattaaagagaaaaaaaggttaaattttattttaagaaattattagtttaatagtattagtaaaaatggtatttttagttatggtataaaatatataataaggttattttttaattattgtttttaagttggaaaatgtattatgaaatatttaaaaagatgttattgggtttatttattaagtgtttttgatattatataaatgatagagtaatattatagttatgtgattgggatttaagaatttttaaatgttaggattgaaaataggtatatgatttatttgtttagaatttatatttttttgtattttaataaaataattaagttatgtgtattgtgtaaaattatagttttttagtttgttttatgtgtttgtttttttggttagatattagttaaaaattagtaaaaatagttattttttttattattttttagtaaagatgtgaaattaaaatgtttaattttttttgtttggtggattgttttttattggattatttgaggtatttagttagtaggttaatgtgattaaaaaggtaaatatagagataaatgtaaatattaaaaaaaaaggaattttttagtatattaatttttattatgaaaataattttagttattttgagaattgataatgaagatgtttatatagttttagttttttttttaattttggaggtagatttgtagtaataatagtaataagtaggagtaatgggtgtattattatgattattttttatgatgattggtgtattaatataaattatatttttttgagtttatttatgttatggatgtttttttatgtataaatatagagtagatatatattaaatagattatatttgttaagttttttgttataagtattaaaattttttagagttgttttttttgtgaaaatttattttatgtagtagtaagttgattttttttgtggtttatttttatgtttgagatttgtagtaatgtaaaattagtttattattattgttaaaatattataaaaaaaaaaggtaataaattaaatttaattttttattatttttagatgaaattaagaagataaatgttatatgtattataaatatttatatatgtatattaagttatttatgttataggttattttttttaaaggatgtttgtttttattagatatatattaataattttaagtgtttaataaaatttgttttttaagtattttaggtatgaatgagtttatgtattttaattttgttttttttttatatgtttaattataatatatgtaattttagttgttttttagtagtggtgttagtatgtgtattttaataattattataatgattttgtaagatgttaaatagttatttttatgttgtttttttaattttttgtaggtagatttggataatagattataagaataatgtagaagaaattaaatgtagataaagaaaaagttttattttatgagaattatgaagatgattttgaaatgtaatttattttttggttttttaattattgtataatttattaatatttttttatgattaagatgttagataatagaataagaaagttattttttttattttagaaaattaagaatggtatgttattttttgaaataaaaatgtgaattaataatattatataatatatatattatatagatgtgtatatttgattaagaaaaaaaagtagtaattttttttttttttttttttttttttttttttttttattttatagagagttttaattttttggtttggggaaggagtaaaggattgatttatataaataaattataagaaaggaaggaaaaatagagatgtttaatggtattttgattaatttgtatttttttgtattttaattagttagttattttgtattgtttttataattgaagaaagtttttttgaatttttaatttttttaaatagttaatttaaagagattattatgaagattttattttttttttagaggaataaaaataatataattttagtttttagaatagtggtttttaattttgtataattaagaaatttttaaatattttttataaatagtttttgaagagttggttatttaagaaattatattattgtaaaaatgtttttatttatttataaagaattttttttaagataattatataggtatatagttaaaaattaatatgtttaatatttaaggtagtttgtatattttttttgggtaaatgtatgatatatatatttaggttttttaataaagttatttataggtaaatgaagtaggaaaaaaagtaataattaaaattttataattttgttttttaaaggatttattgtttaatgttttagtttagtttgtttttattaaaatatttttagtatttaaagttatagtgttgaagtgttttttaataattttttttttggaaaataaaattttatttgtaggtaatatatttagtttttttttaatatttaaatttgggattaaaatgttttggattaaatttagtatttaaaaaaaaaagtattagaatagttggttgatagatattattttgattattaattatgaattattaatattgtttgtattttttttagttaatatagtgtggtgattaagtgtataggttttgagatatatttgggtttgaattttggttttataaataattttttattttttttatttgtaagatatggaaaataataggatttatattttttgggtttgttaggaaagataaaatgagataatatattaatttttagtgtttggtatatgtatttaatagatgttattgttaaattatttttaaatagtttatgttgaaatattaatttgtggttatggttgagtagagttttggtataaaaattttagaattgtaatagaaaataatgtgtattataatgtgaattttttgtaatatagatataatttgtgtttagtgtttgataatttatgagtaaatttagattttatttttgtatattataaatgaggggaagggtttttaataatagtttagtttattagtgtttatgatgtgttgagaattgtatatggaattatgaagattaatgtgatttttttttttaatgagtttataatttgtaggagaggtagagatatatatgaataaatatgggtgagaaaagtatatttaatgaagtatgtagtgtatagaaatgtatattattttagtttagtaaaagggttagtgatggttttgtgggaaataagaaataagtaggatttaattaggtgaagaaagtagtaattaggattttataggtaaaggagataaagagtaagatggtgttgtgtttatagaaaatagtagatttgatggagtagagaattaattaaaggtatttaatgtgattttgtaataggtgttaattggaaattttaaaaaagtaatttagttagtttaaaagatagaaagatataaatttgtttgtatattataaagttttatataagtaataggttaatattattaattttattgtagaattgttaagtggtgtataatttgttattttaaagtatatgtagttattttaggtttgtgaaagtaaaattttatggaagtattatttttaaattgtaagaatttgggtagataaaattagttagttttattaattattttgtttttaaattagtttttttttttttttgtttttaaattagtagtttttaaattgatgtttttagttattttggttataaagttttttgtttagtggattttttatggtttattggaatagtattttttgttaatagtttgtgttttgattaagttagttatgtaggatatgaaagttttattttatattttttttttaagtatttttgttgttaaagtttgatgatagtttaattttttaagttatgtttttttttttgttttttatatttttaaatgattttaagtttagtaattttaatagaatgtattttgatgtttattattttgggttgatatttttaggtattttagatgtttttttaatatgtagttttaaattttttattttaaatgatatttttatagtattttttttgtttttttgttttggttttttttatagatttttgtttaaaggttgatttattttttaaattttttttattttttattttttttaatatattatttgttgtttatgttttttttattttagtttttatttttgaaataatttttttttatttttaattttttttttgagttttattttttagttttattaatgttgattgttttttttttatgttttatattattttattgtttttagtttattttgaaatataaggttataatttttgatttgttttataggtgtatatttttggtttgattttattgtttttagggatgttgtttttttttgtattttgttttttttgtaatattgtatgggatttgattttgttatttttgttattgtttttatgtgaaattagttttttttaatttttagaatgaggtgaattagggtagtttttttaattttatagagttttttttgttgttttttgtatattatttaaaatgatggaggtttgttttgagttttttaggttttgttttttattattttgatttggtttttttttttttttttttttttatgtttttattttttttaatttttattttattttttgaaatttttttttagtatggggttttagagtttttttgggtttattttgagattgtttgagttttttaagtttttagtgtaaatgtattgttattatgtgttatagaagagggtaaaattttttagttagtttttatttttaaattggtttattttattttttggttaggatttattagtgtttttgaggttttattttttttagtgttgttagatgttaattttgttttttattgttttttttagtatagatgttgatattatgtaggttttgtggttgttggtggtttgtttttattaatatgtgttttggggtttatggggatattttattatttagttttgttataaatattaattaggggtttttggttttgttatttagttgattaagttttgtgagaattttagagagatttatgtgtattttttgattttattatttttttagaatttttagtattatttttttttttttaatatttattttgttagataaaatttaggaggtattagttttagtttaatttaggaaaatgataaaataatttttatgttttttattgtttaaatgggaaaggataattatatttattatagaggatttaatttaatttttatgaaattgtttttatagggtaaaatggttgaatgatggtaattttatatggtttaatttattatgtattggtattaattaagtttttttaggttattgaatgaatataggtaatataaaattttaagatttttaatatagaatatagtattattttattttttttaaatttttatgtatttttaaattaatgtattaaattatttagtatttttattttattaattttttatgttgtatttttagtaaagatgtagtttttgtttattttttttaagtgtatgtttttatttttttgatttttttatttagttttatttttgtgagagtatttgtagttaaatttttagattagagttagttttttgtttttttttgataaaaagaaattttaatatgttttgttttaatgatagtttatttgttttatttatgtatatgtttgtgtttagaagtaaatattttttttagtgtttttaaaaatttttgattttatttaaaaaatatttagtaattttttaattatttatttatttatgttatttgagttaatattatttaagattgtgatttatttgtagataaaggtgttttatatatataattatgtatatataaaaaatatttaatgtgttaaatatatgtagatatttaaatttttgtagttaaatgttaaattaaaatgtagtggtatttaaagaattaatttttattataattgttattgtgaagtgtttaatgtgtattgttaatatgaagtattttttagtttttttataatatatggtaaagatatattgtttattttaagaaaaataggaaaaaagtaattgttattaaaataaattgaaaaaatttaaaatttttgtagtaatgtatagatattgtaatgttttatgatagatttttatgtatgggtatttatgtatatttttatgtgattttttgaggaaaataatataggaggtaaaaaataaatatataaattggtttatattgtaaaataaatttaaaatattttattttagaattttttagagaattttttgataaagtatataaattttattaataagagataaggtagggtatagtggtatatttatgtaattttagtatttttgaggtggttttgtttttattaaaaatataaaaattagttaggtttggtggtgtatttttgtaataattttggttattagggtggttgaggtaggagaattgtttgaattaggaggagaaggttgtagtgtgttattgtattttagtttgggtaatagagtgagattgttttaaaaaaaaaaaatgaataaataaaaataaagggataaaagggtataataaaagtgatatatgtggttttatatgtatttttataaataatagttaatttattgttgtttaggaattattgtaaatttttgtaggaaaatattattattggttttatattaattgttttgaggttataagtttaagaaattttttgatgaagttaatgagtttttggatggtttgtgtttgttttattgtttatttttttgtttttataataggagtgttttttatagtttttagtaaaatgttaattgtaaaagaagaataaaatttattgataattatattgaaatatttaaagagaatggaatataaaagatttagaaattagaaatatttaatttatatttattttatgtatttatgatattgaagatatgtgagagatgtaaaaatgttagatttttttttattattttttttttgattttataaagtttttttaataggattaatttttaaaatgttttttattttaataggtagttttaaagagaggaaatataaatgattaatatataaataatatttaagtttataaaaagtaaagtaaaataatgttatgtttttttttatttattaaattagttaaaattagagtaattattagtgtagatgatattatttttgagaatgtaaaatggtatattttttgtggaatgtagtatggtaatatagattttaataaaggtatattttgatttaataatatttttaggaatttagtgtaagaaaatatgagatgtgtgaaaatttatttaaaaagattttatttttatttaagtatttatttttatatgaaatattggtaaatttaaatatttaaaaaggatatttggaggtgattgattaaatagaatgtagtaaattgtatatatttttaattgtttggggtttgaattttggttttgttatttgttgggtatatatgtggatatttaatttttttaatagtatgtataatattttaaatttattaaaaattattataaatatatttatataaatatggaagaatatgtaataaaatgatattttttagtagtgatattgtaggtaatgattatttggatttatttatgttgtttgtaattattaaattttttgtaataaattttttaataaaggaaagtaataagttattaataatagaataattaaagttaaaaagaagttgtagaaagagaaattttaaggttttaatgatttaaaatatagatatgtaaatttaaattttatgaatttgttttttagatataaagttatttgttaaaataaaataaatatatatttggttgggtgtggtggtttatgttagtaatttttatattttgggaggttgaggtaggaggattatttgaggttaggagtttaagagggtttagtttttttttaattttttgtttatgattagtttggttaatatggtgaaattttatttttattaaaaatataaaaatttagttaggtgtggtggtgtatgtttgtaattttagttatttgggaggttgagataggggaatagtttgaatttgggatgtggaggttgtagtgaattgagattaagttattgtattttagtttgggtgatagattgagatatttttttaaaaaaaaaaaaaaaaaaatttatagttaaaaagtaagatatattgaaagtaaaatagtgtattgttgttttttaaagttaattttattttattatattttttttgttttattttttaggtattaaatattggggttaaaagattagaggttattttatttaagtttatttttggaatgaatgtatttagaatatatgatttttatttttttattaaagaattatttaattattttaggtttagttattttaggaataggaatgaatttggagataatgtgggattttagttagtttattttttatatttttttttattgtttttttaaattttttggggttattaataaattgattaatttaattaaatatttttagaaagtgaagtaggaaatattatgagttatgttattaaggatgaagtgtaagatagtgagaaattagagaaggaaaataatttaattatagttgttttttttttttaattttaaaggtgatttgtttgtagttttgaatttggatatatattagaattaattagggaaatatttattttttaggaaatttaatatatttttagtgttaaaattttggtttgttttaataattttttttttgtagattaataaaggttgaggatataaaatagttaagttgtttttattatattatttttaataaataatgataagtataaggtaggaatagttagaaattaagttttatattggagaggtaaatttaaatgttaataagagttagaaaataaaaattttatttttaaatgatagtttaatttgtaaaaaaatattgtttagattaagaaaatatgtttttgggtaatatttagattgtaagttattttttttagtttttgttttgtatagttattattagagttaagtaataagttttgattaagattgttagattttaaaatgaatttttgaatgtttgtttttgtttatagtaaattggaagaaaaaatgtaataaaatattgtaaaatttgtggaatttttttgaagaaagattttagtggttatttatggaaatatttatagtgtattaggtggaaatgggagtttgatttaaagtgggaaggggggtagttttgggagagaattattttttatagtagtagaagttgaagaaaaagtaatgagattaatgttttttttttttttttttttgaggtggagttttgtttttgttgtttaggttggagtgtaatggtgagatttttgtttattgttatttttgttttgtgggtttaagtgatttttttgttttagttttttgagtagttgggattataggtgtgtgttattatatttatttaatttttatatttttagtagagatggagttttattatgttggttaggttggttttgaatttttgattttaggtgatttatttgttttagtttattaaagtgttgggattataggagtgagttattgtgtttggttagagattattgttattttaagatagaatggggaaaatgtttaaggatgaaattagtttttttgaattgaggatgtttatatgttgttttttttataggtaattttaattttaaatagagtgttttagaatatgtaattttagtaattttttttataaagggaaatatttttaagtaataaagggttgaggatagttgatttaagtaatgaaataatttataaaggttttaaaatgtgttttttaaaaaggtaatatttatgtttttagtttttttttagtagtttttattttgtataagaatttggtttttggtttaaggagtgaatttataattaattgggagggggaaaaaagtaaaagtgagttaagttggaaggtatgaattttaatttaggttttgttaatgattatttttattattataaaatattatttaaataattagtttttgtgttaagtatttggaattattgagatttttttttttttgttttatttagtttttttttttttttaaagagtttgtagtttggttaatttaaaaaaatatagtataaaaataagtgtggtagttaagtattaggttttatattgatagatagagatggtattttaatatttaatttaaaggttttaaaaattaaaaagtatatttttttttttttgatgattggttaaaatgtaggtttaggataggtgtttttttaaattttgtttttttattggttgttatttttatttggatgtaatttgaattttttgtttttttgtttggaaataaatttagttatttttttttttggtgttgttagtaggtttttttgtttttggggaaattgtagtggaagatgggggttttggggtggttgtttttggggagatatttgtaagttttttttttttagtagtaattgaagtaggaagttgtaatatagattgtggtttttttgttattttgtttggagatatttgagagtggaagtagtgattgagtgtgtgtagtgggtgtgttttttttta

SEQ ID NO: 66 - DNA, 29256 bp, Artificial Sequence
  chemically treated genomic DNA (Homo sapiens)
tggagaaaagtatgtttattgtatgtgtttagttgttatttttgtttttgagtgtttttaagtaagatggtggaggagttgtagtttgtgttgtagttttttattttaattgttgttggaggggaaggatttatggatgtttttttagaaataattattttggagtttttgttttttgttgtagtttttttgggaatagaggaatttgttggtgatattaagaaaaaaagtaattgaatttatttttgggtagagaggtgggaggtttagattgtatttgagtaggggtggtggttagtaaagaagtaaaatttagaggagtgtttgttttagatttgtattttgattagttattagaagaaaagaagtgtattttttgatttttaaggtttttaagttgagtgttaaaatattatttttgtttattggtgtagggtttgatatttggttgttatatttatttttatattgtatttttttgagttggttagattgtgagttttttgaaggagggagggagttgagtggggtggggggaggggggttttggtaattttaggtatttaatataggagttaattatttgagtaatgttttatggtggtaggggtggttattggtaaagtttggattagaatttatgttttttaatttaatttgtttttgttttttttttttttttagttggttgtgaatttattttttaaattaaaaattaaatttttatgtagaatgaagattgttaagggaaagttaaaggtatagatgttatttttttaagaaatatattttggaatttttgtgagttattttattgtttgagttagttatttttaattttttattgtttgagaatgtttttttttgtaaaagagattgttaaaattatgtgttttaaagtattttgtttagagttagagttgtttatgggaaaagtagtatataagtatttttgatttagagaggttgattttgtttttagatgttttttttgttttgttttaagatgatagtggtttttggttgggtgtggtggtttatttttgtaattttagtattttggtaggttgaggtgggtggattatttgaggttaagagtttgagattagtttggttaatatggtaagattttatttttattaaaaatataaaagttagatgggtgtggtggtgtgtgtttgtaattttagttatttgggaggttgaggtaggagaattgtttgaatttgtgaggtggaggtggtagtgggtggaggttttgttattgtattttagtttggataataagagtgaaattttgttttaaaaaaaaaaaaaaaaaagatattggttttattgttttttttttaatttttgttattgtggaggataatttttttttaagattgtttttttttttattttaaattagatttttatttttatttgatgtattataagtatttttatggatagttattggaatttttttttaaaagaattttgtaggttttatagtgttttgttgtatttttttttttaatttattataggtaagagtggatgtttggagatttgttttaaggtttaatagttttagttaaaatttgttatttgattttgatgatagttgtgtaaaataaaagttaaaaaaaatggtttataatttaaatattgtttgagggtatatttttttggtttggatagtatttttttgtaaattgaattgttatttaaggatgagatttttattttttggtttttgttagtatttgagtttgtttttttaatataaaatttagtttttaattatttttattttgtgtttgttattatttgttgaggataatatgatgaaagtagtttaattgttttgtatttttagtttttgttaatttatagaagaaagattgttgaaatagattaaggttttggtattggaggtatgttaggttttttggggagtaagtgtttttttagttgattttaatgtgtatttgggtttagaattataagtaaattatttttaaaattaaaaagagagggtagttataattaaattattttttttttttggttttttattgttttatattttatttttggtagtataatttatgatattttttgttttattttttggaaatgtttaattgaattaattgatttattgatagttttaggggatttgagggagtagtgaaaggaggtatgaaagataggttaattaaaattttatgttatttttaaatttatttttatttttaagataattggatttaggataattaagtagttttttagtaggaagataaagattatgtgttttagatgtgtttattttaggagtaaatttgaataaaatgatttttgattttttggttttaatatttaatatttaaagaatggagtaagaagggtgtaatagaatagagttaattttagggggtagtaatatattgttttgtttttaatgtgttttgttttttgattgtagatttttttttttttttttttgagaggatgttttagtttgttatttaggttggagtgtagtggtttaattttggtttattgtaatttttgtgttttgggtttaagttatttttttgttttagttttttaagtagttgagattatgggtatgtattattatgtttggttaagtttttgtatttttagtagagatggggttttattatgttggttaggttggttgtgaataagaagttggaaggggattgggtttttttgaatttttgattttaagtgatttttttgttttagttttttaaagtgtggagattattggtgtgagttattgtgtttagttagatgtatgtttgttttgttttagtaaataattttatgtttgagagatagatttatagggtttgggtttgtatatttgtgttttggattgttgaaattttaagatttttttttttgtaatttttttttggttttggttgttttattgttaataatttattgtttttttttattaaaaagtttattatagaaaatttggtagttataaatagtataagtaaatttaagtaattattgtttataatgttattattgagaaatattattttgttgtatatttttttatatttatgtgaatgtgtttgtgatggtttttaatgaatttaagatattatatatgttgttggagagattaaatatttatatatatatttagtaagtggtagagttaggatttgaattttaggtagttaaaagtgtatgtggtttattatattttatttaattagttatttttaaatattttttttgggtatttaggtttattagtgttttatataaaaataaatgtttaaatggaggtgaaatttttttaagtgaatttttatatattttatatttttttatattggatttttagaagtattattgaattaaagtatatttttattaggatttgtattattatattgtattttataaagggtatattattttatatttttaaaagtagtattatttatattggtaattattttaattttaattagtttggtgggtgaaaagggatatgatattattttattttgttttttgtgaatttaaatattgtttgtgtattgattatttgtattttttttttttggaattgtttgttaagataaaaggtattttaaaaattagttttgttgggagaattttgtaggattaagaaaaaaatgatggaaaagaatttaatatttttatattttttatatatttttagtattataaatatgtaagatggatgtagattaaatatttttgatttttaagttttttatattttattttttttagatgttttagtgtaattgttagtaaattttattttttttttatagttgatattttgttaaaggttgtgggagatatttttattatgaaaataaagaagtgggtagtagagtgaatatgaattatttaaggatttattgattttattaaaaagttttttaaatttgtggttttagaatagttggtatgaaattaatggtgatgtttttttataaaaatttgtagtagtttttaggtaatagtgaattaattgttgtttatagaaatgtatatggagttatatatgttgtttttgttatgtttttttatttttttatttttatttatttattttttttttttgagatagttttgttttgttgtttaggttggagtgtagtgatatattgtaattttttttttttggtttaagtgatttttttgttttagttattttagtagttaggattattataggagtgtattattaagtttggttaatttttgtgtttttagtagagatggggttgttttagaagtgttagaattatatgagtgtgttattgtgttttgttttattttttgttagtggagtttatgtattttattaaaggattttttggggaattttgaaatgaaatgttttagatttgttttataatgtgaattagtttatgtatttattttttgttttttgtattgttttttttagaaagttatatgaaagtatgtatgaatatttatgtataaaaatttattatagagtattgtaatatttgtatattattatagaagttttggatttttttagtttgttttgatagtagttattttttttttattttttttgaggtaagtaatgtatttttgttatatattgtgaaagaattaggaaatattttatgttaatagtatatgttaagtattttatagtggtagttgtagtaaaggttaattttttaaatgttattgtattttaatttggtatttgattatagaaatttaaatgtttatatgtatttggtatattaagtgttttttatatatatataattatatgtatgagatatttttatttgtaaatagattataattttggatagtattaatttagatagtatgagtggataggtaattgaagaattgttaagtattttttaaataaaattaggaatttttgggggtattgggggaaatatttgtttttgaatataggtgtgtgtatgggtaaaataagtgaattattattaaagtaggatatgttggaatttttttttgttagggaggagtaaaaaattgattttgatttaagagtttggttgtaagtgtttttataaaagtgaagttaaatggaaaagttaggggaatgaggatatatatttgagagaaatgagtagaggttgtatttttgttaaagatgtaatatgaagagttggtaaaataagagtattgagtaatttaatgtattagtttagaaatatatggagatttaagaaaaatgaaatgatattgtgttttgtgttaagagttttgaaattttgtattgtttgtatttatttagtaatttgaaaggatttgattgatattaatatatagtaggttgaattatataaaattgttattatttagttattttattttatgaaaataattttataagggttaaattaaattttttgtagtgaatatgattatttttttttatttaagtaataggaaatataagaattattttgttatttttttagattaaattaaaattgatattttttgaattttatttagtaaaatggatgttaaaggaaaaaaagtaatgttaggaattttgggaagatggtggaattagaaggtatatgtgaatttttttgaaatttttataaaatttagttaattagatagtaaaattaaaaatttttgattagtatttgtaataaaattaggtgataaggtatttttatgagttttaaaatatatgttggtggggataaattattagtaattataggatttgtatggtattagtatttgtgttgaaagaagtagtaagaaatagggttggtatttgatggtattgagaaaagtagaattttaaaaatgttaatagattttgattgggaagtaaagtgagttaatttaagaatagaagttgattaaggagttttgtttttttttgtagtatgtgatgataatatatttgtattaaggatttgaagggtttaaataattttaaaatggatttaggagggttttgggattttatattgaggagaaattttaggaagtgaaatgaaaattgaaaagggtagggatatgagaaaggaaggaaagagaaagattagattaaaatggtggggaatagagtttggaaagtttaaagtaggtttttattgttttgaatagtatataaaaaataataaggggagttttgtgaagttagaaaaattattttaatttattttattttaaaagttgaggaaaattaattttatataaaaataataataggaataataaggttaaattttgtatagtgttataagaaaaatgagatgtggaaaagaatagtatttttagagatgatgaaattaagttagaaatatatatttataagataagttgaaaattgtaattttgtattttaaaatgagttaaaaataataagatggtataagatatgaaagaaaaatgattagtattagtaaaattaagaaatgaagtttaggaaaagaattagaaataaaagaaaattattttagaaatggagattaaagtaggaggaatataaataatggataatatgttaagaaaaatagaagatgaaaaaaatttaaaaagtgagttaatttttggataagagtttgtgaagaaaattagagtaagggaatagaaaaaatattgtaaaaatgttatttaaggtaagagatttgaaattatatattgaaaaaatatttgaagtatttgagagtattaatttagaataatgaatattaggatgtattttgttaaaattattggatttgaaattatttggaaatgtaggggatgggaaagagggtatgatttagaaagttaggttgttgttaaattttgatagtaaagatgtttaaggaaaaagtgtgaaataaggtttttatattttgtataattgatttaattggggtatagattattagtagaaaatgttattttagtgaattatgaggaatttattagatagagagttttataattagaataattagagatattaatttaaagattgttgatttaaaagtagaaagaaaaaaaagttgatttaaaggtaaagtaattaataaaattaattaattttgtttgtttaagtttttgtagtttggaaataatatttttatggaattttatttttataaatttggagtaattatatgtattttaaagtaataaattatatgttatttagtgattttgtagtggaattgatgatgttaatttgttatttatatagagttttatagtatgtaaatagatttatgtttttttgttttttgaattaattgaattgtttttttaaaatttttagttaatatttgttataaaattatattgaatgtttttggttggttttttgttttattgagtttgttgttttttgtgaatataatattattttattttttgttttttttgtttgtgaagttttgattattgttttttttatttggttaaattttgtttattttttattttttataaagttattattgatttttttgttaggttagagtagtgtatatttttgtatgttatatattttattagatgtattttttttatttgtatttatttatgtgtgtttttgttttttttatagattataagtttattgagggaagagattatattaatttttatagttttatgtataatttttagtatattatagatattgataaattaagttgttattgagagtttttttttttatttataatgtataagagtaaaatttggatttgtttataaattgttaggtattgaatataaattatatttgtattataaaaaatttatattataatgtatattgttttttgttatagttttgaaatttttgtgttagaattttatttagttataattataaattgatattttagtatgaattatttaaagataatttaataataatgtttattgagtatatatattaggtattgaaagttagtgtattattttattttgttttttttaatagatttaagaggtataggttttattattttttatattttataaataaagaggatgagagattatttgtaaagttaggatttaaatttaggtgtgttttagagtttatatatttaattattatattatattggttaagagagatgtaagtaatattgatggtttatggttggtgattaaaatagtatttgttaattaattattttgatatttttttttttaaatattaagtttaatttaggatattttagttttaaatttggatattaaaggaaaattaaatatgttatttgtaaataaagttttgttttttaaaaagaaaattattaaagggtattttaatattgtgattttaagtattagaaatattttagtaaaaatagattaaattgaaatattgagtagtgaattttttaaagagtaaggttataaggttttaattgttatttttttttttgttttatttgtttgtaagtgattttattaaaaaatttaagtatatatgttatatatttatttaaggaaagtgtataaattattttgaatattagatatattgatttttggttgtgtgtttgtgtaattattttaggagaaattttttgtgggtaagtggggatatttttatgataatgtaattttttgaatagttagttttttaaaagttatttgtaaaaaatatttaaaagttttttagttatataaagttaggaattattgttttaggaattggaattgtgttatttttatttttttggaggaaaaatgagatttttgtaatgatttttttaaattgattatttagaaaagttaggagtttagagaagttttttttaattgtgaaaataatataaaatagttagttgattggaatgtagaaaaatgtagattaattaggatattattaaatatttttgtttttttttttttttttgtagtttatttatgtgaattagttttttgttttttttttagattaagaagttggaattttttatgaggtaaaaaaaaaaaaaaaaaaaaaaaaaaaagaaagaaattattgttttttttttttaattgagtatgtatatttgtataatatgtatattgtgtagtattgttaatttatatttttattttaagagatggtatgttatttttaattttttggggtagaaaagatgatttttttgttttgttatttaatattttgattatagaaagatattaataaattatataatgattgaagaattaaggaataaattatattttaaagttatttttatgatttttataaagtaaggttttttttttatttatatttgattttttttatattgtttttataatttgttatttaaatttgtttataagaaattgagaaaatagtataagaatgattgtttaatattttatagagttattgtaatagttattagagtatatatattagtattattattagaaaatagttaaaattatatatattgtggttggatatgtagagaaaggataagattaaaatatataagtttatttatgtttaagatgtttaaaggatagattttattaaatatttaggattattaatatgtgtttgatagaaataggtattttttgaaagagatagtttgtaatataggtaatttaatatatgtgtgtggatatttatgatatatgtggtatttatttttttagttttatttaagaataataaaagattgagtttgatttattgttttttttttttgtagtgttttggtagtgatggtaaattggttttatattattgtaagttttaggtgtggggatgaattataaagaaaattaatttgttattatatgaaatggatttttatggaagagatagttttgaaaagttttgatgtttgtggtaagagatttaatagatgtgatttatttagtatgtgtttattttatgtttatgtataagaaaatatttatagtatgaatggatttagaaaaatgtgatttgtattaatgtattagttattataaaagatggttatgatagtatatttattgtttttatttgttattattattgttgtagatttgtttttaaggttgaaaaggagattaagattgtataaatatttttattgttagtttttaaaatgattgaaattgtttttatggtaaaagttaatatattaaagggtttttttttttttaatgtttatatttatttttatgtttatttttttagttatattgatttgttggttgaatattttaaatagtttagtagagggtagtttattaggtagaaaaggttaggtgttttggttttatatttttgttggggaataataggggaaatggttgtttttgttaatttttagttaatatttagttaggagagtaagtatataggatagattgaaagattgtaattttatataatatatatggtttaattattttattgggatatagaaaaatataaattttggataaataagttatatatttgtttttagttttaatatttaaggatttttgagttttaattatataattgtggtgttattttgttatttatatggtgttaaaagtatttgatgagtaaatttagtagtatttttttgagtgttttataatgtattttttaatttgaaaataataattgaaaaatagttttattgtatattttatgttatgattaaaagtgttatttttattgatgttattagattgataattttttgaagtgaaatttaatttttttttttttttagtattatgtttataatgttatatttttagaaagtattttagattaggtatggtggtttatatttgtaattttagtattttggaaggttgaggtgtggggattgtgtgaagttataagtttgagattagtttggttagtaaggtaagatttttaattttataaaaaaataaaaattaaaaaaaaattattaggttgtagaggtaagaggattttttgagtttagaagtttaagggtatagtgagttgtgattgtattattgtatttttgttgagtaatagagtgagattttattttaaaaaagaaaaaaaaaggtattttagtaaattgaatgtaatgtgaatggaattttaaaataggatttaagatggtatgtagtagaatttaaagtaatattattttaaagttaaatgagtatggaaaaggtttgttttttagttttgtttagtttagtttattgaaggaatatatttaattatatttatatatttaataaataaaaatatgttgaatttttgtattgtttgttattgagggtttagatgatagattttaaaaaattgaaaatattggttgaaatttgtagtatttatttagttattttttttgatttaaataatttaatagtttattaaatttaaggttagttaaatatgtagttaattttatttgtttttttttttaataattttgaagaatatataggattttgtattttttttttttttttttttttttaaagagatagtgttttggttttgttgtttaggttggattgtaatggtataattttggtttattgtaatttttattttttgggtttaagtgatttttttgttttagttttttgagtagttgggattataggtatttgttattatatttgtttaattttttgttatttttagtggagatagggttttattattttggttaggttggttttaaatttttgattgattttaggtgatttatttgttttggttttttaaagtgttgggattataggtgtgagttattgtgttgggtttggattttgtatttttttaaattatatttaattattttttgatttttatttaaagaattattttgtgttaaatttgtaatattaaataataattaagtttggatttgataagttattgggtgattagaatttataatataatttatttttaatttaaatttttaagtttgattaaatttgggggaaaaattgaatatttaggtgatattttaaattttttttgtgattaaatagatgttattaatattatgttttattttattgtgtatagatgatttatggtatataaagtatatgtataatattgtaatattgtatttttatttttaaaagtatgttaaagattttataatgaatttattatatttaaggaataaggtaaattaatgtttatttgaaattaaaatgagattggataatttttggaatttgatttttgtaagttttagttttaaagggattttaaatatttattagaatgaagtatagtgtattttttagattatatgatattagttaattaatttagttgtaatataaagtgagaaagttttaggtgttgaaggagtgtgaaaataaaaatttttttttatgtagtttttgttttattttttaaggattataatatgttgagtaaatttttggtattaaggaagttagttataggttatgtaatgaaaattatttagaaaatagtttagtaaatattattatttgaatatagtttaaattgtatttatataaatattttgtttatattatttaatttaaattggattatttattattttttgaagatgttttgtgttttttgttatttatttttgtttgtgtagtttatttatatttttatttttttaaattttaatttttttttaaggtttgatttagattttaattttttaaaggttatttgaattatttaaggagaagatatttttttttttataaaaatatttagagtaaattattattattaaattatttattgtatattgttttagagttatgtgtttagttattttggtttttatttggtatttatatatatataatatttagtatatttttttatatgtaaataattagtaatgtaatatattgagtgaatgaaattgtgattagtaaagtatgatagttaaaaataaaggaaattttgtatagtttaagtttttgtatagtagaaggtaatggaaaatatttgtaatatatgatagtgtttttaatgttttaagtatatgaagaatttgttttaattggtaagaaaagattaattgaaaaataggtaaaatatattaaattttgatttataaaaagatataaatggttaataaaatatgaaatattttgaattttattggttataaaaaatataaataaaaataatgttgattgataataaaaataatgtatattttgttattagtagagttgtggggaaattttgttatattttggtgaatagaatatgagttggtatattatttttagggggttatttggtaatattaaaaattttgaaatgtaagtataaattttagtttgtttgtataatttgttatttatatattgagtgtttattatgttttaaatattggaataatattaataaagtttataagagattaataaagtttttgtttttggagttatttttatgttgatttaagggggtaggatagatttttagatttgaatttaaattttggaagtttttaaaatagaatttttagaaataatggaaagtaatttgatatttgatattagttattatatttatgtttttgtatttaatattaatgaaagataaaatgtgagtaaaatttttagaggaatttttataaattaatttttatagttttttttgttatagttgatatatatgaatttaggttgattatttttagtgatagataaaaaggatgttttgtttattttgagatggttttatttgttttataattgttttttttataatatggtaaaatttgtttttttgttttttttaagtatttgtttttagtttttttatttatatttataaaatatattttttttttttttttgttttattttttttaagttttgttttaagaatgataaatttatttttatagttgtttagaattttgatttttttttaatttagttttaatttattagttttattatttaaagtaatttatagatttaatgtaattgttattaaaatattagtgatattttttattgatatagagaaaaaaaaatttaaaatttgtatggaattataaaagatttagaatagttaaagttattttgagtaaaaatagtaaagttagaggtattatattattgggttttaaattatgtattataaagttatagtaataaaaatagtatgatagaagtataaaaataagatatagattaagggaatagaatagagaatttagaagtaaatttatgtatttatttatagttaatttttttgataaagatattaagaatatatattggggaaaggataattttttttataataaatggtgtaggtagaattgagtatttaaatgtagaagaatgaaattagattttttttttattatatataaaaattagaatagattaaagatttaaatgtaagatttgaaattatgaagagaaaattggggaaattaaaagtttaagttgggtaaagattttttgtaagattttaaaaatataattaatgtgaaaatgagtaaatgagatgatattaagttaaaaagttgtatagtagaggaaataaagtgaagaaatatgttatagaatgggtaaaaatatttgtaaattatttatttgataaggaattaaaaatgaatatataaagagtttaatagtaaaaaaaaattaaaaataggtaaaagatttgaataggtgttttttagaagatattaaaatgggtaataggtatatgaaaaaatgtttaatattattaattattagggaaatgtaaattaaaattaaatgagttattatattttagtttaaatgatttatttaaaagataggtaataatggatgttggtgaggatgtggagaaagaatatttgtatattgttggtgggagtgtagataattaaagttattaaggagaagagtatgaagtttttttaaaaaatgaagaaaagaattattgtgtaatttagtatttttattgttggttgtaaatttaaaggtaagaagatttgtatattgagatatttgtattgtagtagtatgtataatagttaagatatataattaatttgagagtttatgtatggattaatggataaagaaagtgtatatgatgttattttgagttttaaaaaagaatgaaattttgttatttgtaatatggaattggaggatattgtgatgttaagtgaaagaagttaggtatagaaaaataaatagtatatatttttatatgtgggagtttaaaaaaaaaatgtttttaggattggttggtaagatggttaaataggaatagttttagtttgtagttttaagtgagatgaatgtagaagtgggtaatttttgtatttttaattgaggtattttgtttattttattgggattgggtaggtagtgggtaaggttaaagagggtgagtagaagtagagtggggtgttgttttatgtaggaagtggaaggagtaggggagtttattttttttagttaaaggaggttgtgagggattgtgttatttggtttagatattatattttttttttggttttagaaatttatagattaagagatttttttatgtgtttatatttttagggttttgggttttaaaaataaaattgggtagttgtttaggtagatattgagttagttgtaggagttttttttatatattgatagttgaattgattagtggaagaaaggatattagagattgaagattaatttattgaaatgaggtgtgaaggaaagattgagaaaaaagattgaaatggaatgaataaagtttttaagaaatatgggattatgtggaaagattaaatttatgattgattggggtttttgaaagtgatggggagaatgtaattaagttggaaaatattttttaggatattattgaggagaatttttttaatgtagtaagataggttaatatttaaatttaggaagtatagagattattataaagatattttttgagaagagtaattttaagatatataattgttatagtttttaaagttgaaatgaaagaaaaatgttaagggtaatagagagaaaggttaggtaatttataaagggaagttattagattaatagtggatttttgtagaaattttataagtttgaagagagtggaagttaatatttaatattgttaaagaatttttaatttagagttttatatatagttaaattaatttttataagtaaaggataaataaaattttttatagataagtaaatgttgagggatttttgttattattaggtttgttttataagagtttttgaaggaagtataaaatatggaaaggaaaaattagtattagttattgtaaaaatatattaaaatataaagattaatgatattatgaagaaattgtattaattaatgtgtaaaataattagttagtattatgatgataggattaaatttatatgtaataatattaattttaaatgtaaatgggttaaatgttttaattaaaagatatatattggtaaattggataaagagttaagatttattagtgtgttgtatttaggagatttattttttatgtaaagatatatataggtttaaaataatgagatggaggaatatttattaggtaaatggaaaataataataataataaaaaagtagggattgtaattttagtttttgatataatagattttaaattaataaagtttaaaaaagataagggtattatattgtggtaaagggattaatgtaataagaagagttaattattttaaatatatatgtatttaatatagatgtatttagatttataaaataagtttttagagatatataaagtgatttagatttttatataataataatgggagattttaatatattattgttaatattagattaataagatagaaaattaataaggatatttaggattggaaattaatgtgtaaaaattataagtatttttatatattaataaagataagtagttaaattatgagtgaatttttatttataattgttataaagaaaatatttggttgggtatggtggtttttgtttgtaattttaatattttgggaggttgaggtgggtagattatgaggttaggagattgaaattattttggttaatatggtgaaattttatttttattaaaaataaaaaaataaaaaaaattagttgggtgtggtggtgggtatttgtagttttagttatttgggaggttgaggtaggagaatggtgtgaatttaggaggtagagtttgtagtgtgagtttagattgtattattgtattttagtttgggtgatagagtgagattttgttttaaaaaaaaaagaaaatatttaggaatatattttataagggatatgaagggtttttaaggttttttgtttaaggagataagagagaatataaataaattgaaaaaaattttatgtttatggataggaagaatttatattatgaaaatggttatattgttttaagtaatttatagatttaatgttatttttattaagttgttattgattttttttatataattagaaaaaaattattttaaatgttatatggatttaaaaaagagtttgtatagttaagataattttaagtaaaaagaataaagttggaggtattatattatttgatattaaattatattataaaagttatagtatttaaaatagtatggtattagtattaaaatagatatatatattagtgaaatagaatagaggttttagaaataatattatatatttataattatttgatttttaataaatttgataaaaggaagtaatggggaaaggattttttatttaataaatggtaatggtattgggaaaattggtttgttatatttagaaaatagaaattggattttttttttatattttatataaaaattaaggtggattaaagattaaaatgtagaatttaaaattataaaaatttttgaaaaaatttaggtaatattatttaggatataagtatgggtaaagattttatgattaaaatattaaaagtaattgtaataaaatttagaattgataaatgggatttaattaaattaaagagtttttgtttagtaaaagaaattgttattagagtgaataggtagtttatagaatgggagaaaatttttttaatttatttatttgataaaggtttaatatttagaatttataaggaatttaaataaatttataagaaaaattaattttattaaaaagtgggtaaaggatatgaatagatattttttaaaagaagatatgtatgtagttaggaaatatgaaaaagagttgattattattgattaattggagaaatgtaaattaaaattataatgagttagtattttatattagttagaatggtaattattaaaaaaatttggaaataatagatgttggtgaggatgtggagaaataggaatatttttatattgttggtaggagtgtaaattagtttaattattgtggaagatagtgtggtgattttttaaggatttagaattagaaatattatttgatttagtaatttaattattaggtatatatttaaaggattataaattattttgttataaagatatatgtatatttatgtttattgtagtattgtttataatattaaagatttggaattaatttaaatttttattaatgatagattgaataaagaaaatgtggtatatatatattatggaatattatgtagttataaaaaagaataagtttatgttttttgtagggatatggatgaagttggaaattattatttttagtaaattaatattgtaatggaaagttaaatatgttatgtttttatttataagtgggaggtgaataataagaatatatggatatagggaggggaatattatatattggggtttgtgggtgggttgggggtaaggggagggagagtattaggataaatatttaatgtgtgtggaggttaaaatttagatgatgggttgataggtgtagtaaattattatggtatatgtatatttatttaataaatttgtatgtttagtatttttattatagaatttaaaatgaagttgtttttatggaaatatagtgtagatgatggttattagaggttgggaagggtagtaggaaaaggggaatgataaagggttggttaatgagtaaaaaaaatatatagttagaaggaaaaaaatttagtgttgggtagtataattgggtgattatagttaataatatatattttaaaaaataattagaaaagtggagttggaatgtttataatataaaggatgagaaatgtttgaggtgatggatattttagttatttttatttgattattatatattgtatgtttgtattaaaattttatatgtattttatatatatgtatatttatgtatttataaaaatttaaaagtttgattgatttatttgtaaaatatgtttagagtttagttattttttatttgttattattgtggatagagttattattatagtttttttttatttaaattgtaataattaatttgttggtttttttgtatgtattttttttttgtttagaatttttagtggttttttatattggtgtaaaagttgaagtttttattttggtttatgtgatatgtggttattatttttttatattttgttatttaaatgttgttatttaaatattaagttttttgtaattttagggttgttgtatttattggtttttttatttggaaatttgttttagataaatgttttgttaatattttttagtttttgtttaaatattattttaaggaaatgtttttttgaattttttttgaaatagtaatttgttattttatttatttaattttttttgttttatttttttttattgtgtattttattaagtatttgtatgtttatttttttatgtatgttgtatataatatttgttggtgtgttttttttattaatttaattttattaaaatgtaagttttttgagggtagtggtttagttttgttagtagtgtttggtatatagtatatgttttttaaaatatgttggatagtttttttttttttatatttattattatgttaatgtttgtttgaaaatgtgatagttattgattgttttggataatttagagtatagtagagttatttttttggatttaggtattttatttatgttaataaagtttataatgttaattttttttaatgattatatttaggttataatatgtaatattgttgggaagaatttagatgttttttgtaaagaatttgaaaaaagttttttttggatttgaaattataattttaggatttttaaagaggaatgaggaattagatgaatgtttttattagttaataattttagtattgaggaattttagttaatatgtttttattaattttatttatgtatgtatttaagaaatatttttatttgtgtttaatttgtataaaatattgtgtgttaggttttgatggtgatataaaaataaaatttaagaggagtttgttttaaaggtttttattgttaaagtgatttatgtaagtaattgtaatatatgttgagaaatggtaagtgttttaaggaagatagtgattgttttattgtttaggaggaggagaaatggtatatttgataggaaagtaaaagttggattttaaaataagattgggatatgttgaaatggttggttaggatttaagtagaaggaaaagtttaagtaaaagaatggatttggtaagtatatttaatttggttgaaagatatatttataaagaaaaataataaaaggtgaaatattaagaaaggtagtttatagttaaaatatgaaaaaaaaattaatgttagtttgataagatttattgtataggaaagttagagttattggaagaatgtgattaggaaataatattattagttttgtgttttaggttaagaaattaagtaattgtgaataaaggatatatatgggagaaagttggaattaaggaatttattttagaggttagtgttataatttagttaaaattaaatagaggtttgaatagtggaatagtaataagaatataaagtagagaaaatgataaggagatataaaatttggtaattggttgaatggggtttggataatgatgtaaggaaggagtaggtagtagtggatgaggtttttgagtttgggtgttttattgtagaaatagaatttttaggagtttggaagagtatttttgaaaggagttttatatatattgtattggaggtgttaaaaggtgttggagattgtagtttgtatgtaaaattaagggaatgtgggtggtatttatatatagataattaatgaaattttgagtgtgagggaagggaggaagttgagagaagaaataataaaaatgtgttaatattagtatattaagaaagttttttgaggtttttgaaggttaagaggtggagttagatgggtataaagatggtaataatagatattggggataattagagggaggatggaggagaaaaagggttgaaattgttggatattatgtttagtatttaggtgataataatatttgtattagaaattttagtattatataatatatttaggtaatttgtatatgtaatttttgaatttaaaaagttgaaaagagggtaggtatagtagtttatgtttataattttaatattttaggaggttgaggtaggaagattatttaagtttagtagtttaagtttagtttgtgtaatataataagattatatttttataaaaaaataaaaaattagttaagtgtggtggtgtatgtttgtagtttttgttatttagtaggtgtaggtagtaggtttgtttgagtttaggtgttgaaagttgtagtgagttaatggttttattgtattttagttttagtgatatagtaagatttttgtttaaaaaaataaataaaagattagttatagattgggaggaaatatatataaattatatatttgatttgtttttagaatatataataaatttttaaaatttaataataagaatagataattaagtttttaaaaggataaaatatttggatattttattaaaaattatttataaataattaattatataaaaatatgtttaatattattagttattatgagagataggataagttggattttttaggttgattaagaatttttaagttttagttgggaaaggtgattgtaattatttttaaatatggggtttgtaatttagtttatatttaattaattaggtagtaaagagggtttattaaaatataaattaggttaaagtaggaggtaaagaaatagttaaataatatattgtttgagagtatgggggagggataatgatttggatataaatttaggtattaaagtagggagtggtaattttttttgtgtgttgttgtattgtatgggagttgtgtttttattttattaaatttagtaattgtatatttttttggtttgtgtttgttatggtttgagttgagtttttgtttgttttttattattgttgtttgttattgttatagatttgttattgatttttatttttttagatttggtagggtgtttgttgttttgttgatttagtgaggtatttattgttatttttgatttggttaaaggtttgttattgtttttgtatggttaagtgtttgggtttgttttatttgagttgaatattagtagttgggttttatggtttttttttgtgatttatggtttttaatagagttataatatttattgtatggtttaaggttttattttttggaatttatgaggttaagaattttagtttagagaataaaaggtttgttgttattttgggagtggtggttattattttgggagttttaagaataaagatttgtttataagaattagagatatagaaaatgaagaatataatgtaatattagtatatttttatttggttaaaattggtaaaattgataatatttggtgaggatgtggggtaattagaatttatatattattgttgagaatgtgaaatggtatagattttttgtaaattagtatgttaattttttgtaaatttaaatatgtattgattaaatggtttagtaattttatttttaggtatttatttaggtgaaatgaaaatttttatttatttgaaaaaatatttgttgaataaattaatgaatgaataataaatgaatggagttattataatgtaaaatgattagataatatttaaaattgttgaaataaaaaaaaatataagtttatttttggaaaaaggaagtaattattataaggaatagttagaagagttaagagattgattttttaagtataggatagatggttaggaatggttaaaagggtttgttgttttttattgattttttagtattattgattttttttaattatgtgaatatattatttttataaaaatgtaaaaagaaaaagaggagttagagaaagaaaatgaattgttagaaaaatttagaagttttattaattgaaatgtagaaaagataaattgtgtttgtattttatttttgttgtttattttaaatatttatggattagattagttgaaatgaagtaattaagagatttaatagaaaatattgttaagaataaaaaataatttgaggaaattatgaaaagtttataggttattttgttataaaatattttgttaatttattattttgtagtaatatatattattaaggttggtttttggaatgttttttatttgtagttatttttgaataataggtgattttgtttttaataatattgttagaatataatgtagtgagttttattagagatgtttaagattatttggtataagtaaattttattgtatatatgtatatatatgagggagggtgattatagtttagaaaaaaataggtttttagaagtttagaattttaataattttaaatttaaattattttttgtgtttatttataatgagaaggaagaaatttatatttgtattttttttattttttatattttttttatttaaattttattgtatttgatttgtgttgtttttaatgtattaggtgttatgtatgatgtagaaatgtgtttttttatatgtatgtattagtaggtttttttaagtatatgtttaaggttgaaagatttaaatataattatagttttttaaattattgtgttagagtttgttttatttttttagaaaaagtttttttttatattattaaatgaaatattaggttatttgtattggatattttttaaaagaaaatatttgattttaaaattaaagagtttttggttttttattattttattaattgttttattagagatttgagttttttttgttaaaatatattttagtatgtattttaaaaaatatgtgtgtgtgtatatttaaatatatatatatataaagttttggatttatttttatttagtttggggtatattgtggatagttttaattgataaaataggtattttttggtttaggagtggaatttatttttaatttttgtaggttttttataattttttatttggaagaagtgtttttttttttttttttttttttttttttttatttagtgttagtttttgtagttattttttttgattttttttgtttatgttttagtgttgtgaattatagtggtggaggtggagtggggagaggtgttaggttgggtggttaaaatgtgttgttaaagtgggggagagattgtgtggagtttatgtgatttttgggatgttggagataatggggtttttgggaaggtgtggagtttggggaagttggggatgtgtgtgtgagttgtgtttgtagggtttttttgtttttgttattttttttgggtggttttttgttttgttttttttttgagggttgttggtatatttttagtgattttaagtgtttaaaaggggtttgggaggatgaattttatagatttgaatttgatttgtgtgtgtattgtgtttttagtgattttggatttattgtgttgttaggggtttgggggtgggttttttgttgtttttgtgatgatatttttatgttttggtattttaatgttgggtttgtgtgtgtgtgtttgtttagtggtttagtgggttgttaggtttttttgtttttagttttttggtttgtttagtttttttattgtagtttagtagtgagatgtgtgtgtagttagttttttatgagatggaatagattgaagtgttgaagttatggattttggttgatttgatttgtattttgtattagttttttgttggtgatgaggttaatgtagaggaggtgtaggttattatggaagtttatgagagtgattttattgagtgggtaatgtatgttaagtttgattagtataggtgagtgtgttgtagttttaatgttaggtggtgtttatttgttttgtttgaggaggaatggatgtgggggatgtagtttaaagtgattggtttgggaagtttgggttgtgttgtgtttgttgtttgtttttttgttggttagttgtggggttggtatgatttgtttggggttttgtggttatagtgtaggtggaaggtggattttattggttttgttgatttttggttgggaatggtggataggtgttgggaagggaggttattgtgtgtttgtgagattttttgttttttttttttttgtaaatttttttgtttttaaattattagtttttttgtttttggttttgggagtaatgtttatatttttaagttattgttaattttgggtgtggagatgtggagagattgtatttaggtttgggtttttttgatattttaaggaattgtttggttggattagtagagggtgtttttaggggagtattatattagttattgggagaagtgtgtgatgttgaagaagataagttatttgtgttagttttttattattgtgtttttggttgtttgtaattgggtattttatagtaagtatttttatttatgtaaaatagtgttttgtggttgttagttgttattatggaatttttgttgtttttttttttaaattaatttaattaatttttttgattgtgggtttatttaaatttattgttaagttttgtagattaaatatttgattgttgttttttttagtttttaaatgatttgatttattttatttttgtttttgatgatttgtaatgtaaattaaagatttttattttttagatgtatttgagtgaggtgttttggtaagttggtttttttgtagttttggtttggtgattaagttgaatttttttattaattttttggggttagaggtaaaatttaattattttgaagtgtgagaggttttattttttttgagtagttagtgtgttagtttttgtggttttttgggtttagggttaggagaaaggggtaagtgaaagaaaagaataaggaaagaagtaagtttgttttttttgggagtaggtttttttagttattttttaatatgtgggatgttttgtaaagttttgttggtatgggtggttttaattgtattttaggatttgaaatagaaaaagtgaagattattaaggattttattttttatatataagtgatttgaggaaatttttttggtttttattagtttagtttatggtagagtttttttgtagttgtgaaagttagtagagagtttagtttttaaatttttttgtatttgttttaggtaattgaagatttgttatgggataggtatttttttagatatttgatatatatgaggaatggtaggtaatgaagaagttgaatgatttgtattaggttttttattgatagtggttttaggtttttggggttagtattgttgttttagagtttatattttaaattattgttaaattaggataggttgtaatagtttttaatttttaatttttagaataagtgtatttttaaggattttgaattagttttgattgataaattttaaagtttttgaagtgtaattagttgggttgattggtttttttatagatatttgaggtatagtttattaatataatggatgtagttttgagggggtagttgggggaagataggagatgggagagaagttaattttatagtattttttgtattaaataggtgtttagtgttgtgaaggattttgttttttgattttgggagggttagtgtagaagaattaagatagaatatgtttttgtgtgggttaggttgtgaattttttgaaagaagttgtagagaagtaataaagattattttaagatttttggaggaagaattaggatttttttgtaggaatttagtttattgtgaattgaaggttgtgtatatagttttttgttaggttataaaggttataaagtagggaaaattgaggttaaaaagtatttattaagtaattttttttaggattatgttttttggatattttggggtggggaggaatgggataggatggaaggggtatgttggataagagttaattgatgatgaagggaaaaaaaatttttaaaaaatggagtaaagattttttttttttaatatgatagtttaaatgaatgttataattatgaaattttgttaattagatgttgttaatagtatattttggattaatagaaattttgatgttgattttgttttttttatagttgtggttgtggtttgtagtttgttgttggtggtggtagtggtggtggttggttgtggtgagtgtgtttgtgtgtatgtgtttgttagttattggttttttttaattgtaagaggtttagagggttttttattttattaatgtagttttttttgttttggtagttagattagtttttatggtatttgtggaagattttttattataagggtttttgaatgtggtttgtgtttaggttttagtaaaattaagaattttagaatagttatttaatgaaattttgttttttaagttttgatttagttataggtagaaaaaagaaaaaaaaaaaaataatagtaatatttttgttttaattagtaatgtattttggaaatattttttttgagaaatttattttattagtttgaggttgttatattgagaaatatgtaattttggttttttttttgttattttttttgtgttattaattaaaattgagtagttatttttgtaaatgtagtggtttaaaatgaattgtgaaaaaggattttttatttgtgttggatttttaattagaaaattgtatttaaagttgtttagaggtggaaatgttaatatttgtgaataaatggtatttggtgatatatttattttttttagtgtttgttttagtaatgaatttaaaatttttgaatatattgtttttttttaggtatatttgaaattttgtggattaaggaaatggaaaatttaatttgatgattttttgttggggtgaaggatatggtaggtaaaataattatttatttatagatatttattagagtatgttttttagtatatgaaaaatatagtattaggttagttataggttttataagtagtaataaattttatttttttttttttttttttttttttttgagatagtggtttatttttgttgtttaggttggagtgaaatggtatgattttagtttattgtaatttttgttttttgggtttaagtaatttttttgttttagttttttgagtagttgggattataggtatgtattattatgtttggttaattttgtatttttagtagagatggggttttattatgttggttaggttggttttgaatttttgattttaggtgatttatttattttggtattttaaagtgttgggattataggtatgagttattatatttagtttttattttttatttatttgtttataatgttttttaattttaataaaaattattaatggaattagtatagggtatttaggtatatattatatatattaaaattagtttttaaaatgaatagtaaattaaatgaggtaagtaatttttttaagttaattatattttgttttttgtgtagtaaaattttatgtgaaattgtgtttatatttgatatttgtggtgtttgaggtgtgtaaataattgtgggattaaagattaaaggatggagatttgaagttagaaaagtattgtaaatttagaaaatttttttttattttaagttaattttttagtttttttattgaaaaggtaatttatattgattttttgaaatttagttttttaatttatttttagttttatgt

SEQ ID NO: 67 - DNA, 26339 bp, Artificial Sequence
  chemically treated genomic DNA (Homo sapiens)
ttgaatattgtgttgaataggagtggtgagagagggtatttttgttttgtgttagtttttaaagggaatgtttttagtttttgtttatttagtatgatattggttgtgggtttgttataaatagtttttattattttgagatatgttttattaatatttagtttattgagagtttttagtatgaagggttgttgaattttgttgaaggttttttttgtatgtattgagataattatgtggtttttgtttttgtttttgtttatgtgatggattatatttattgatttgtgtatgttgaattagttttgtattttagggataaagttaatttgattttgatggattgtttttttttttttttttttaaattttttgtagagatgagagtttattattttgtttaggttagtttggagtttttgagtttaagggaatttttttgttttagttttttagagtgttaggattataggtttgagttattatgtttagtatttttttttttttttttttttttttttttttttttttttttttttttttttttattttttttttttttttattttttttttttttttttttttttttttttttttttttttttttgagatagagttttatttagttattgaggttggagtgtagtggtgtgattttagtttattgtaattttggttttttgggtttaaatgatttttttgttttagttttttaagtagttgggattataggtgtatattattatgtttagttaattttttgtattttttagtagagatggggttttattatgttggttaggttggttttgaatttttgattttgagtgatttgtttgttttggttttttaaagtgttgggattataggtgtgagttaattatgtttagtttttttttttttttttatttttatgtttattttggatttaaggggtatatgtataggtttgttataagggttgattttgtgatgttgagatttgggtttttattgattttgttatttagatagtgaatataatatttagtgggaagttttttagtttttgatttgtttttttttttatttttgagtttttagtgtttattttttttatttttatgtttgtatgtatttaagatttagttgttatttataagtgagaatatgtgatatttggtttttagtttttatgttaatttgtttaggataatggtttttatttgtatttatgttgttgtaaagaatgtgattttattttttatggttgtatagtattttattgtgtatatgtattatattttttttatttaatgtattgttgatgggtatttagggtgagtttatgtttttgttattgtgaatagtgttgtaatgaatatgagagtgtatgtgttttttgttagaataatttattttttttgggtatatatttagtaatgatattgttgggttgaatggtggttttatttttaatattatttttttttttattttataattgaggagtttttttgagttttaatgtttatatatttttaagtagaatgttttatttatttatagaatatataatggaaattatttagttattgtttaataggtagtttttgatttaatatgttttgagaataatttttatattattagtatagagattaaagatgtggttttataattttgatttttttttaaaagagtaaattttaaagtttgtgatattgtttgtttaattaaaagggagtaattagtatttatagttttgtaatggagttttttataagggaaattagtgtttaggttgtgaataaagtttattggttagtatgtttttgatgtttttggatgttttttagtatttattataaatattaatagtatttgttttaatatttgttttaaaataggtattatataagattaaaaaatttttatgtttatttatggaggatagtttttgaatattttttaaatgatagagattatgtattttatatgaataggttatagaataaaatattttagtttttattagttattaaatttaggatttttttttttaattatagattgtaagagggtagtaatatgtatattttaaaaaatatatataggtgtatatgtatgtgtgtgagtatatatatatatatatatttaataatgagtgaggtttatgaaattgggttatgggttggtagttataattttatttgtagtatttttttattatataaatgttaaaatgggattatagtgtggaaatagaagagtgtaggatatattagaatttgaaattttttttaaggatatgaggtgtttggtagaattttatttatatgttaggaaattttaatatgagttttttaagaaatggaattgaaaagtttagaggaagaggtgagtttataattattaagtatattgaaataaatgaggtttggaattttgtattaagtttgttaagttttattgtgtttttgttatggggggaatttggattttttttttttttttattttattttttgtttttaatatttttaatatttggagtggtaattattgaaaattggagagggatatagagtgatttagggagggtaaagggaggttttttttttgtttttgttttttgaaagttttaaaatttgaaaattattttggagttttttgaaaatgtttagatatatttaagaatttttattgagtaatataatgttttaattgaggtatatatgttgttttaggagtttgtgaaattttaaagataaaagtttgattatgtttgttttgattttaatgaattatttatataattttaatatatagtgtttaatatgtatgaaagttgtgtaatattttatattttaataatggagaattattaagtaattttggttattttgatattagtattttttgaaattttttaggttgatgtggtaaaggagaaatagtaattttgagttttgaaaagttaggttgtattttggttttgaaaaattatttgttgtgaatttgggttagtttttgattttttaaatggtataatagtttgttgttataagaggttatattaggaaaattttttaaggatttaagattttgtttatttattgagtttttttgggtgatttgtttaggaggaagtatttgtttttttttgagttgttttattaaagtatttgagtgagaaggtagaatataatgagaatgattatgttggtaaggaagatatatatatgagatgggttattttttatatttatgttagttaaaattgttttttatgaataaatttagtatttggtattttatttgatggttttaaaaatagagttttaaatttagaaggtaaggtgttatttttagtttttttttttggaggaaaatagtatgtattgtgttaggttaaggtttatggggatttgatttagtatttgggtaattggttgttaatggaattgaagatagttgggtttaataagtgtttaggtgatttaggtaagtgaggaaattagattgaggtttttttgtgtgggataggttaaattttgattaaattatagttgagttgggatgtttttttgtttaaagtttaaagtttggatgtggttggtagggtgtattggtgtgtgttttgtaggttatttttttgattggaatgatggtggtggttggttttttggggttgttggggttttttggggtatgttgttgttaggatttttgtagggtgtagatagtaggttttagtgaggttgtggaaggaaagttttgggtgttggggttgggtttggtgttggtttttgggttgggggggtgggggttgtgttgagatgtttttaggagaagttttgttgttgttgttattgtggttgtttgaggtgggtgtttttgggatatagttttggtttttggggttgtgtggtttatatgatagtgtggagtatgaggttgaattttattttttagttttaagtttttttattattagggttgggtggttttgttaggtagagtgttggtttttttaagagtaaatgatttggatatgtttgtgaagtttgtgtgaagaaggggaagtttgtggttgtttgtgtttttttgtttttttgtggttgtttggttgaaattaaattgaggggtggggtggtgaggatagggtatgttgtaggtttgtgtgggttgggtttggatttgtgttgttttgggatgtaaagtataataagagggttgggatgggtagtgtaggtttgtgaggtttgtgggtgtttttgttttttagttttttttgtagttggttttgtagtggtttattttggttgttgggtgtggatttgggttttggattgaaggttgtgtgttttttgttgtttattgtggttttgataggttggggttattgtggtgattatgagagtagttttggtgttatggaggagtttggggttattttttaattgtatttggggttgtttttggaggagttatgtagggtgagtttaggtgtgatgagtgttatgtggtttaggggttgtgggagttgttgggggaaggaagtagtagattggttttggggtttaagttgttgtggttagaggttttgaagttagtttttgtttgttgtttggtttttgtttgtgtttgaggtagtagttaggtttgtagggtgtttgagtggtttttgtgtgatggaggaggatttggggttttgggaaggtgaagaaagtatttgtttagttggattttgtaaagatgtaaatgttttttgatttttaaaattaattagtttttttgttatgttgtttattttgagtagagatatgtggtttttttgattgtgagaaatttgaggattgtttttttaaattagttatatttattgatgtaattttttgttgaattttgaaagaatatttgaggttgggtggggagttgaaattttgattttgtattttttttttttttggtaaagaatgaatgtttttttgagatgttttattatgagtgagattgttttttgtttttgttttgttaatgtatagtttagagatagtaaatttttagtgtttaaattttgttttttattttttaggtttagtttataattaagttgtagagatttttttttttaagtgtttttaggtatttttgttgatatgtgtaggggtatttatgttgttgtgtttttaaaaattggattaaatttttaaaaagattatttaattattgaggtagttatgattatgtttttttgttaggtgaattaaaggtagtgttgttatggtgtttatgagtttatagtttgtttaatgtatatgtatatatatgtatttaatatgaaaagagtatttttatggagattttaaatggattaagatttagttttggttattagtattatgttgtttgttaagagagagaagataaaaaaaaaaatagtataaagtagaaattgatgaagtgtttatttaagtatatatatatagtgtagggaattaggagttgtattatttagagtgtaaagtgggtttagggagtgatgggtaatgatgtttgttggagatgtaagtaggttttaagtgttgtaggtgttggagagtttttgaaggtttttttgtggttagatttgtggtttaaaatttaagttttttttgatagtagtatgtagattagatgttagggaaataaaatttgaaatagggattaagggagaggtgatagtagtaaggataggaaagagggtattgtgtggagaaatagtttttaagagttaaaatatgtttgattttattgattgtatgtgaagggtgagagagaaggaatttagaaggatttttaggtttttggttgtggtaatttatttatggaggtagggtttttagaaagagaagtatatttttttttttttattaaaaataataataattaagatttagtttttataggattgttagtgtatatggagaaatgtagaaatatatggagaaatgtagttagattttgtagttttttttagtttggtgtgttgtatttttatttgtatagtttttttttttttttttttttttttgttaaatgtgagtattttggtttgggggttaggatggtataatattgttttgttttaaattttttttttatttttaaaaattattttgtattgagatatatttatataatataaaatttatttttttataatgtttattttagtgttttttttgttaaatttattatgttatgtaattgttagtatagttttttaatatttttattattttagaaaataaattttattgattagtagttttaatttttattttttattttttgataattattaatttattttttgtttttatgaatatgtttattttgtatgtgttatgtagttatgttatatgtggttttttgtttggttttttttatttagtatgtttttaaggtttatttatgttgtagtatgtaatagagttttattttttttttttttttttttttttttttgagatagggttttatttttgttatttaggggggagtgtagtggtttgattttagtttattgtagtttagatttttttggtttaggtgatttttttattttagttttttgaataggtgggattatagtatatgttattaggtttggttaatttttttgtattttttgtagagatagggtttttttatgttatttaggttggttttgagtttttaggtttaagtgatttgtttatttaggtttttaaaaatgttgggattataggtgtgagttattttgtttggttttttatttttttttatggtgaaaaaatattttgttgtgtgattatattatatttatgttatagttgatggatatatggattattaatattttttggttattatgaataatgttgttttgtgtataagtttttatatatgtttttagtttttttgggtaagtatttgggtggaattgttgagttatatttattatatgtttaattttttgagaattgttaaattgttttttagaggttatattattttatatttttattagtagtttatgagggttttagttttttgtattttttttaatgtttgtgattttttgtttttttttgtttttaattgttatttttgtgggtgtataggtgagtggtattttattttgttgtggtttttttttttttttttttgagattgagttttgttttgttatttaggttggagtgtagtggtatgattttggtttattgtagtttttattttttaggtttaagtgatttttttgttttagttttttgtgtagttgggattataggtattaattattatatttggttgatttttgtatttttagtagagataggttttattatgttggttaggatgattttgattttttgattttgtgatttatttgttttggttttttaaagtgtagggattataggtgtgagtttttttatttggttttattttgttttttgttgttgttgttgtttgtttgttttgttttttaagagatggggttttgttttgttgtttaggttggagtgtagtggtgtgattatagtttattgttgttttaaatttttggttttaagggatttttttgttttagttttttagagtgttggtgttatagatgtgagttattatattaggttttgtggttgttttgatttgtatttttttagtaattaatgatgttgagtatgtgtttattgtttatattttttttggggaaatgtttattgatttttttttgtttatttaaaaaatgggtggtttttttattgttgagttataagtattttttatatatttagggtgttaaatgtttattagataaatgatttagaaagatttttttttattttgtgtattttttttttatttttttggtgtgttttttgaagtgtaagtgttttaaattttgattaagtttaatttattttttttttttttggttgtttgtgtttttggtattatagttaagaaattgttgtttaagataaggttataaatatttatagttatgtttttttttaagagttttagtttttatgggaagttttttgatttattttgagtgattttgtttttatatatgttatgaagaatgggtttagatttattttttggtatgtggatatttattggtttattttagtatgatttgtttgaaagaattgttttttttttattgatttgttttaatattgttgaaaataatttattataaatttaagggtttatttttggattttgatttttattttattggtttgtgtttgtttttatgttattattatattatttttaaaatatttttttatttaatgttttgattattgtttttttgtagtaagatatagtagggaagtatgagttttttagtgttgtttttgtttatttatgttttttttttttattaatattgttttggttatgtggagttttttgtatttttatataaattttaggaatttagttttaggaatttaggatttagtttgtttatttttgtaaaaaaggtagttggaattttaataggggttgtattgagtttgttgattagtttagggagtattgtttttttaataatattaagttttttaagttgggtgtagtggtttatgtttgtaattttagtattttgggagattaaggtgagtagattatttgagtttaggattttaagattagtttgggtaatttggtgaaattgttgtggtttttttgttttttagtttagttaggtttaagtttttgttttataattaagaagaattaggtatgtggattttagagagtgagtggaatagaatttattaagtgaaaggaaagtttttagtaaagagggaatgtagggggtggtttttttattagaaggtaggaaagtttttttgtgtggttgggtttgtggttttttgtggatttagaatggggagtgtatgttgattggtttgtgagtatgtaaaaaaggttaaagtaaagatattatttagaggtgggtgtgataatgtagataattaattaggaggttgggtgtggtggtttatgtttgtaattttagtattttgggaggttgatgggggtggattatgaggttaggagtttgagattagtttggttaatatggtgaaatttttttttattaaagatataaaaaattagttgagtatggtggtgtgtgtttgtaattttagttatttaggaggttgaggtaggagaattgtttgaatttgggaggtggaggttgttgtgagttgagattgtgttattgtattttattttgggtgatagggtgagattttattttaaaaaaaagaaaaagaaaatttattagtaaagggtaggtatatgtaaaataggtgaaagatggggattaattagaggaaagtgggttaaataagaaggtaagtttttaatttggtttaaggatttaatttgtggtttggtttttaggttttaaattgtttttggtttgaagttggggttttattagggatttgtttttatttgtttgggtatttggttgttttttgttatttttaaaattttgtttttaaaagaaatataaaaattagttgggtaaggtggtatgtgtttgtagttttgttgtttgaggttgaggtgggaggattatttgagtttggggagggtaaggttgtagtgagttaagattgtattattgtattttagtttgggtgatagatttagtttttgttttaaataaagaagttttttagtttatggatgtggattggttttatatttatttaagtttttttttgttgttttttataatattttgtagttttagtgtgtattttttttgttaaatgtatttttaataattttattttttttgatgttattatagatggaaatgttttttttattttatttttaggttgtttattgttgttgtatagaaatttaattgatttttttatgttgattttgtattttgtaattttgttgaatttaatagttttgatagtttttttataggttttttaggattttttttgtgtatagaatagtattatgttatttttaaatagttttttttttttttttttagtttggatgttttttatttattttttttttttaattgttttggttagaatttttattataatgttgaatatatgttgatagagtggatattattgtttttgattttaggagaaaagttttttttttttttttttttttatttttaagtatgatgttaattgtaggttttgtatagatgttttttgttaggttgaggaaatttttttaaattgtattttgttgagtgtgttttgttttttttgttgtttgtttgggatagggttttattttgttgtttaggttggagtgtagtggtatgattatgatttattgttgttttgattttttgggtataggtgatttttttattttggttttttgagtagttgggattataggtatgtgttattatgtttggttaatttttgttgaatgttttgattatgaaatggtgttagatatagttaaatgttttttttgtgtttattgagatgattatgtgttttttttttttttttatttttttaatatggtttataagattattgtatgttaaattaattttgtatttttgggataaattttatttggttatggtatataattttttttatatgttgttggatttggtttgttaatatttttttgaggatttttgtatttggagttataagatatattggtgtgtgattttttttttttgtgtgatgtatttgtttggtttttagggtaaatattagttttatagaataagttaggaagtattttttttttttttatgtttgggaagagtttgagagtgattggtgttaatgttttattttggagaggtgtatttttatggaattttgtgttatagttaagtatttatagggtttgtatgttgatattttttttgttattagtatatattatgtttgaagttagatgaaaaataattttagtttatttttagtatattttgttaatttgattaattgattttttttaaagttatttgattttgaatttttttagtatttatgttttggaaatggaatagattttaagtgttttgtgattaattattattgtattttatggagggttatttttggaggggttatttattattttttaaattttagtttattagattatatgtaattttgtattatatttgttgatatttgagaaatttggttgttttttttatgtttttgtgagatagggtgttatgttgtagataaaatttaagggtgaaaaatttttttgagaaagttagaataatttagattagagtaatgaatttgagatgaattttttagaatttagtttttttttttttttttttttttttttttttttttgagatggagttttattttgttatttaggttggagtgtagtggtgtgtttttggtttattgtagtttttttttgggtttaggtaatttttgtattttagttttttaagtagttgggattataggtttatgttattatgtttagttaatttttgtatttttggtagagatggggttttattatgttggttagattggttttaaatttttgattttaagtgatttgtttattttggttttttaaagtgttgggattataggtttgagttattgtgtgtggttaagatttagattttttgtttttttttagtttgttagatttaattagtttaaggttttattttattttatttttttaaagttttttttttttgtaattttagtattttgggaggttaaggtaggtggattatttgaggttaggagtttgagattagtttggttaatatggtgaaattttgtttttattaaaaatataaaaattagttgggtatggtggtgggtatttgtaattttagttatttgggaggttgaggtaggagaattgtttgaatttaggagatggaggttgtagtaagtttatatggtgttgttgtattttagttttggtaatagagtgagattttgttttaaaaaaaaaaaaaaattttttttttttttaaattattttttaatttttatgtttttttaattttttgtgtgtgtgtgtgtgtgtgtgtgtgttagagtttagttttgttttgttatttaggtttgagtgtagtggtgtgatttgtagtttttgttttttaggtttaagtgattgttttattttagtttttttagtagttggaattataggtgtttgttattatgtttggttaatttttgtatttttagtagagatagggttttgttatgttggttaggttggttttaaatttttggttttatgtgatttgtttatgttggttttttaaagtgttggtatgagttattgtgtttggttttagtttaatgttttaaattagaatttattatgtttttttagaagagaagagttgataaaatgtgattgaatttaagaaatattattgtattaaaggtaattatgtgtttgatttgagagatgtttttggaattgttttttaaagtagagtgttataggttatattgattatataatttttgagttagtgtgtgttttatgtgttgaatatattagttaaaagtaagatgtttggaaaatgtgtaaattgtgaagaaaatttttttttttggtattgtgtattgaatgtttttttttttttaatagtaaaaataatttttttttattattaattgtttgtaatgatattagatttttgtgaattggtatttagggtaatgtagggagaggtagaagtagagattagggtaaagggatattttttagaagtataattaggtttgtttggtataggttatgaagtatagatagtattttggaaggagtatatatttggattagagttataaaagattttggagaggaaaataattattaaatattgtttttataggtagaaagggtttaaaaggaagatttgttgtagaggttttgggttaaagtttgaaaagaattaaattttattatattttagattgtttttaaaatggtattttttttttttttttttatttttttttttttttttttgattaagtaatattttgggtttggtaataaagagtagaataattttattaggtaaggatgagtaatgagttgatttagagaaaggtgaaatatagaagtaatagtaaaagttttaggttgtgttgtgttgaaggtttgttgtggggagaagtaatgtggaaaggttatggttagaagattagggtttttggaggagataatataaataattatttttttttgagtatttgtttggtatgtttaaatagtattatttttattatatttaagagaagggatgtatagaggtagggtggggagatttaaattttaaatttaaatttttattagtggtgtttaaaatttgtttttattttttgagataggttttattttgttgtttaggttggttttgaattaaattttttatttttaaagttgtaaattgattttttttttttgtagggaaattgtatattggggaattgattatattttatagataaaatttgaattggttgaaattagggtaagagtatttgaattttaggttatttagtttttttttttggtttttttttatttttatttttggaaattttaagttatttttgtagaattttagtttgaagataattgtattttattatattgttgttttttatttggtgatagtgattgaaagttgataaaaaaatgtattttgatattttttgtttggtgttagtttggtagtttattttgtgttgattatataaatttgtatttatgtttgtaattaatatttttattaaaagtatatttttaagaatttatttttttttattttgaaggttgtggtagtattgtttgaaggtatgagattagattttaatttttatggttttttatgggaattggtgatatgtgtagttgttgttggattttttgttgtttttttttttttgtggagaagttttagattggtaagtaattagtgttatattaagagaatgtttattttgttattgggttgaataaataatatgagaaatatatttgttattttaagtaaataagttagaaattatatagggatttagaggtttttgttttttgttttttgttttttttaaaagagatgagggttaggaatgagagttaggtttagtgttgtggtttttatttttaattttagtattttgggaggttaaggtagaaagattatttgagtttaggggtttgtgattagtttgggtaatatggtgagattttattattataaaaaatataaaaattagttggatatgaggatatttgtttgtggttttggttatttaggaggttgaggtgggaggattgtttgattttgggaagttgatgttgtagtgagttatggttgtgatattgtattttagtttgggtgatagagagagattttgttttaaaaataaagagatgagggttttgtgttgtttaggttggttttaaatttttgggtttaagtgatttttttgttttggttttttaaagttttgggattataggtttgagttattatgtttaattggaattttttaatgtaagattttttatatatatatatatgtgtgtatatatatatatatatatatatgtgtgtatatatatatatatatatatatgtgtgtatatatatatatatatatatatatatatatatttatatttaaagagatggggttttattatgttgtttaggttgtagtgtagttgttatttatagatgtaattatagtgtgtttatagtttatagttttaaatttttgggtttaagtaatttttttttagttttttgagtagttgggattatataggtttatgttattttgtttagttttattttttttttaattttgggaaattttatttgagataggattttatttttgttatttgggttggagtgtagtggtatgattttggtttattgtaatttttgttttttgtgttgaagtaatttttttgttttagttttttgagtagttgggattataggtgtgtattattatgtttggttaatttttgtatttttttgtagagatgggttttattgtgttgtttagaatttttggttttaagtgatttgtttgttttggttttttaaagttttgggattataggtattaattattatgtttggtttaattttgggaaatttttaatgtatttttgggattgttattttttagatgttgttttttttatttttgatttttttattttttaatttttattttttaatttttttatggttttttatattttttgagagttttttaatttgaggaattgaaatttattttttatttatatttattgtagagtattttgttttttaaaggtttttttttttatttttatttatattttgtagatgattgaagtttttattttttttttatttgtttgtgttattttagttttaaggttgatttttttataaatgaatttttgtttgttttattatttgagagagaggttaaggaagaaaaaggtttggtttattgtttttttagttagtttagatttatggttttatggtaatattttttaggttgttttattttggatattggtattaagggatatgataataggggttttttgaaattatttttttagggttaaatttgtttggggagtaatgggttaaatgaaattaaataagtatttttagagtaaagttattttagagtttttaatatgttaatttataatgtgaatttttaatagggagtttttaataagtagtatttaggttgggtatggtggtttatgtttgtaattttagtattttgggggatttaggtaggtggattatttgaggttaggagttttagattagtttggttaatatggtgaaatttggtttttattaaaaatatgaaaattggttaggtatggtggtgggtatttgtaattttagttatttaggaggttgaggtagaggaattgtttgaatttaggaggtggaggttgtagtgagttgagattgtgttattgtattttagtttgggagatagagtaagattttgttttaaaaaaaaaaaaaaaaaagtatttatttttttattggaaatagaatatttttggtttgtatttatataaaggtaataagaaatttgtatttttaagttggtagtagatgttaaatgaattgatttatttgagagtgtatttgttttaatgtaatttttgttaaaaatttgttttaggttaggagttggttttatgtgggtaagtttttttttttgttttgatttttattgttgtgttgtaaaaatttataataatttatttatggtaatattgatttgatttttttaggatgagagaaaaagtttgttttaatgttttttggattaattgaagaaaaaagtaaattatttgaaaaatttagttttgtttaaaaagaggtaagatatttttgaaaataatatttatgttagagttagagaattttatattttttattgtaggtatttttgtgtaaatttaagattatgaatgttttgtttgtagagtatgagagttttttttgttttttatatttaatatttaattagttttattaattttaattattgtagtaggtgtataatggtgtttttttgtgttttttttttgagtttttttgattgatgaggttgagtatataaatatattttttgtatgtgtatatttttggtatttgtttgtgtatttaaatgttttttttttgtaaagatattagttagattggattagggtttattttaataattttattttattttgattatttttaaaggttttgtttttaaatatagttatattttgaggtattggggttggagttttaatatgtgaatttgtggggatataatttagtttataatagtttttgatttatttgaaattagatttgtgatggtgtagttgagggtgtgtgtgtgtgtgtgtgaagatttatttttttttttgggtgtgttgagttaatgttatttattggaaggattattttttttttgttgttttgtagtgttatttttttaagttattgaatatatgtgagtttgtttttgttaaattttttattttgttgggttttttgtttgttttttgttaataatatgttttttatagtttgtagttttataataagttttagtatttggtatggttaatttatagtttttggttattgtgaataaagttattgtgaatatttttttataagttttttttttgtgggtatgtatttttatttttttttataagtagtagtggaattggtaagttattagggtattagggtaggtatagtttaattgtgtaagataagaaattggttgggtatggtggtttatgtttgtaattttagtattttgggaggttgaggtgggtaaattatgaggttaggagattgagattattttggttaatatggtgaaattttgtttttattaaaaatataaaaaaattagttaagtgtggtggtgggtatttgtagttttagttatttgggaggttgaggtaggagaatggtgtgaattaggagatggagtttgtagtgagttgagattgtgttattgtattttagtttgggtaatagagtgagatttttttttaaaataaataaataaataaataaataaaaaaattttattggttgtttttattatttttttttggttttggtttttagtagtgttattatgatttgtttaggtgtggtttttttttatttgtttttattggggtttatgatgtttttagaatttgtggtttaatgttttttattagtttagtttttttttttttttttttttttttgagatagtgttttttttttttttttgtttaggttgtagtatagtggtgtgattttggtttattttaatttttattttttggatttaggtgatttttttattttagttttttgagtagttgggattataggtatgtgttattatgtttagttaattttttaaaattttttgtagagatggggttttgttatgttgtttaggttggttttgaatttttgggtttaagtaatttttttgttttggttttttaaagtgttaggattatagttgtgagttattgtgttttattttttattagttttgaaatatttttgattgttatttttttatatattgtttttgtttttttttgttttttttttttgggattataaaaatgggtattttaattttttattatattttatttgttttttatgtttttttttagggtttttatttttttgtttgtttatattttagtttagatataattttttttaatttttatgttgttaatagtttttatttatgtttataattattttttaaattatttattgagattttaattttattttttgttttttttagttttgtagttttattgtggttttttttgtagttttttttttttggtataattttattttttaattttatttatatattatgtttttttatttttgttttgttttgttttggtttttttttttttttggagatggagttttttttgttgtttaggttggagtggagtgtagtagtgtgattttggtttattgtaatttttgttttttaggtttaagtgatttttttgttttagttttttaagtagttgggattataggtatatgttgttatgtttggttaattttttgtattttagtagggatgggttttattgtgttgtttaggttggttttaaatttttgagtttaggtaatttatttgttttggttttttaaagtgttaggattataggtgtgagttattatgtttggtttatgtttttttattttatttatttatgtgttatttttattttttgatttttagaatatatgttgttgataaatatgtttttttattttaatgattattgtattatttagtagtttatttttggtgtttatttttttttttgttttttagttaagttttgtttgtttgaatgttaggttattttatatgaagtgttagtgataatataataaaaattgtaaagataattttgaagttgtgggtgttgttgtttttttttagtgaggatttattgttgttttttataggtagttaggttagggatattggaaattttagataattttatgtatttgatttttttttatgtaaaataagttttattgtgtatatttaaggtatagaaattttagataattttgattttgttttttgtaaaataagttttattgtatatatttaaggtataaatatgatgagatatgtgtatagtaaatggttattatagtgaaataaattaatgtatttttttttttttatagttatttattttttgtttatttttttagggtagttataatgtatttatataataaaaattatgaatgtagtatattattattaattatggattttatgttgtatatgagattttttaatttgtttattttatatattttttttttttttattgagatagggttttattttgttatataggttggggtgtagtggtatgattttggtttattgtagtttttattttttgggtttaagtaatttttttattttagatttttgagtaattgtggttataggtatatgatatatgtttgtttgatttttaaattttttgtagagatggggtttttttatgttgttaaggatggttttaaattttttggtttaggtgatttttttgttttagttttttaaattgttgggattataggtatgagttattatatttggttatattttttgatttatatgtttttttttttttatttaatattgttaattattgttttgttttttatttttatatatttgatttttataaaaattttgtatataagtgagattatgtaatatttttttttttatatttggtttattttatttagtaaaatgttttttaggtttgtttatgttgtagtaaatggtaggatttttatttttttatggttgagtaatattttattgtaaatatatattatagtttttttatttgtttgtttattgatagatatttaggttgtttttatattggttattgtgaataatgttgtagtgaatatgggtatgtagttgtgtgtagaaggtgttaattttattttttttggataaatatttggaagaaggtttgttggatatagtagttttattttaaatttttttaggagtttttatattattttttgtagtgattgtatttatttatatttttgttagtagtgtatagtaagtttttaatgtttttgatagatggttgaaaattgattttaagtgaaatagtgtatattgaatttagttttttttttttattaatgttataatgaaataatgttgaagaaaataatgttatttaaaggataaaggatttgttttatgtttttttttttttttgtttagaaaaagggtttttttttttttgtaatttttaagtttaggggtataagtgtatatttgttatataggtaaatttgtgttttgggggtttgttgtagagggtttttttttttttatatttttataaatatttgttattttttttgtttttttgataatagttattttaatagatataaggtagtattttattgtgtttttgatttgtatatttttgatgattggtgatattgaatattattttatatatttgttggttatttttatgttatttttagagaaatatttatttaagttttttgtttgtttttaaattaggttgtatgtttgtttgttgttgagttgtatgaggttttttaaaatattgaatattaattttttatttgatatatttttttttaatttgtaggttgtttttttattgtgtttatttgtgtatatttttattttttttattttgtagttttattttaaaggaatttttattttattgttttttttgttttgtaaaagttttttagtttgatgtagttttgtttatttattttttgtttttgtagtttaagttgttgatgtgatagttaataaattattgttaaggttagtgttagggagttttttttttgtgtttttttttaggagttttgtagttttaggttttatgtttaggttttttatttattttgagttgatttttatgtgttgtataaagttaagagtttagttttatttttttgtgtgtgaaatttagtttttttattattatttattgatgagattattttttttgtattgtatatttttggtgttttattgaaaatttgattatatttatttggatttatttttgggttttttattttgttttattggtttgtgtatttgtttttatattagtattatgttgtttttgtgattatagttttggaatataatttaaaatgagttagtttgatgttgttaattttattttttttagaattgttttgattatttgggattttttgttattttatattaaatttagattaaaaaaatttttgtgaagaatgttattgagattttggttgtgtttttatttttttgtgtgttttttaattttttttattaatgttttatattttttagtgtgtagattttttatttttttggttgaatttgtttttaggtattttattttttttgatgttatgtaaataggattgtttttttttttttttttttttttattttttttttattgattatttttgggtgttttttgtagagggggatttggtagggttataggataatagtggagggaaggttagtagataaataagtgaataaaggtttttggtttttttaggtagaggattttgtggttttttgtagtgtttgtgtttttgggtatttgagattagggagtggtgatgatttttaatgagtatgttgtttttaagtatttgtttagtaaagtatattttgtattgtttttaatttattgttaattttgagtggatatagtatatgttttagagagtatagggttgggggtaaggttatagattaatagtattttaaggtagaagaattttttttagtatagaataaaatgaagttttttatgtttatttttttttatatatatatagtaataatttgatttttttattttttttttattttttttttttttttattttataaaattgttattgttattttggtttgtttttaatgagttgttgggtatattttttagatggggtggtggttgggtagaagggttttttattttttagaaggggtagttgggtagaggtgtttttttattttttggatggggtggtggttgggtgggggttgttttttattttttttttggaaggggtggttggttgggtgggggttgatttttttattttttttttggatggggtggttggttgggtgggggttgattttttattttttttttggatggggtggttggttgggtgggggttgattttttattttttttttggatgggatggttggttgggtgggggttgattttttgattttttttttggatggggtggttggttgggtgggggttgttttttattttttttttggatggggtggttggttgggttggggttgattttttattttttttttggttggggtggttgttgggtggagatgttttttattttttagatggggtagttgttgggtggaggggttttttattttttagatggggtggttgttgggtggaggggttttttattttttagatggggtggttgggtagagatgttttttattttttagatggggttgtggttgggtagaggtgttttttatattttagatgatgggtggttgggtagagatgttttttattttttagatgggatggtggttgggaagaggtgttttttattttttagattgggtagttgggtagaggggttttttatattttagatgatgggtggttaggtagagatgttttttattttttagatggggtggtggttgggtagaggttgtaattttagtattttgggaggttaaggtaggtggttgggaggtggaggttgtagttagttgagattatattattgtattttagtttgggtaatgttgagtattgagtgaatgagattttatttgtaattttggtattttgggaggttgaggttggtagattatttttggttaggagttggagattagtttggttaatatagtgaaattttgtttttattagaaaaatatgaaaattagttaggtgtggtggtgtgtgtttgtaattgtaggtatttggtaggttgaggtaggagaattaggtagggaggttgtagtgagtggagatggtagtagtatagtttagttttggtttggtattagagggagattgtggagaggggagaggggagagggagagggagattgttttttagattttgtttttggttaggttgttatttgtgtatagaaatgatatagttttgttttgatattatattttgtatttttattgaatttagttattatatttgtatttttgatgatattttttgggttttttatatataggattatgttatttgtgaatagataattttatttttttgatttggatattttttttttttttatttttttttttttttttttttattttttttttttttttgagataggtttttattttgttgtttaggttggattgtagtagtgtaattttagtttattgtaatttttgttttttgggtttaagtgatttttttattttagttttttaaattgttgggattatagatgtgtattattgtgtttggttatttttttgtgtgtgtgtgtgtgtgtgtgtgtgtgtgtgtattttttggtagagatagggttttattatgttggataggttggttttgaatttttgattttaagtgatttgtttattttggttttttaaagtgttggtattataggtgtgagttattatgttaggttttttattttttttttttgtttaattgttttgatagtatttttagtattattttgtttttgttttttgagataaggttttattttgttgtttaggttggagtgtagtggtatggttatggtttattgtagttttagttttttgggtttaggtgttttttttattttagttttttaagtagttgggattataggtgtgtattattatgtttagttaattttttgtattttttttgtagagatggtgtttggttaagttgtttaagttggttttgaatttgggtttaagtgatttgtttattttagttttttaaagtgttgggattataggtgtgagttattgtatttagtttttttagtattgttttgaatagaagtggtggttgtgggtatttttgttttgtattagattttaatggaaaaggttttagtttttttttattgatgatgatatttgttgtaagttttttataaatggtttttgttatgttgaggaattttttttttatttttttttattattttaaaaattttattatttattatttatttatttttttgagatgaagttttgtttttttattaggttggaatgtagtggtgtgattttggtttattgtaattttgttttttgggtttaagtaatttttttgtgttagttttttgagtagttgggattatagttatgtgttattatggttggttaattttttgtattttggtagagatggggttttattatgttggttaggatggttttgattttttgattttatgatttgtttgttttggttttttaaagtgttgggattataggtatgagttattatttagttttttgagataaggttttgttttgttgtttaggatggagtgtagtggtatgtttatggtttattgtagttttaattttttggggttatgtgatttttttattttagtttttttagagtagttgggattataggtgtgtgttattaagtttggttaatttgtttatttttggtagagatgtggttttgttatgttgtataggttggttttgaattttttggattttttaaagtgttgggattataggtgtgagttattatatttggttagaattttatttttatatttaaattgttaagggtttttattaagagatgatgttgggttggatgtgagggtgtgtgtttatagttttatttatttgggagtatgaggtgggaggatggtttgagtttaggaatttaagtttaatttgggtaatataggagaatttattttttaaaagaaaaaaaaaatggatgtttaattttgttgaatgttttttttgtgttaattggtatgattatgtggtttttgttttttagtttgtgaatgtgatgtattatattaattgatttgagtgtgtatatattatatatatatatatatatatatatatatatatatatatatatatatatttttttttttttttttgagatggagtttggtgttgttatttgggttggagtggaatggtgtgattttagtatattgtaatttttgttttttgggtttaagtgatttttttgttttagttatttgagtatttaggattataggtgtttggttaatttttgtatttttagtagagttagggttttattatgttggttaggatggtttggaatttttgattttgtgatttgtttgttttggttttttaaagtgttgggattatatgtgtgagttattgtgttggttaatttgtatatattaaattggttttgtatgttagggataaatattatttgattttaatgtataatttttttgatgtattgttaattttaatttgttgatattttatttaggatttttgtattagtgtttattagagatattgatttgtaggtttgtttgtttgtttatttatttattttttgtggttttttggtttggtttaggtattaaggtgatgttggatttataaaatgtgttaggaaatatttttttttgttgttttttttggaagagtttaagaagttttggtaataattttattttgaaaatttggtaaaatttagttgtgaagttatttttttttgggtttttttttgttgggaggttagattattttaataatagattgagatatttggaagttgggttttagtttagaggattagtttgtttttggttttgattttgttgtaaggtaggtaggttttttttttttttttttgagatagttttgttatgttatttaggttggagtgtatgattttgatttattgtaatttttgttttatgggtttaagtgatttttgtgttttagttttttgaatagttgggattatgagtatatgttattatgtttggtt

SEQ ID NO: 68 - DNA, 26339 bp, Artificial Sequence
  chemically treated genomic DNA (Homo sapiens)
agttgagtgtggtgatgtgtatttgtaattttagttatttgagaggttgaggtataagaattatttgagtttatgaggtggaagttgtagtgagttgagattatgtattttagtttgagtgatatagtaagattgttttaaaaaaaaaaaaagaaaatttgtttattttataataaagttgaaattaaaaatagattaattttttgaattgaggtttagtttttaaatattttaatttgttattaaagtaatttgattttttaataaagaaaagtttaggaagagatggttttatggttgaattttattaaatttttaaagtagaattattattaagattttttaaatttttttaagaaaaataataggagggaatattttttaatatattttatgagtttagtattattttgatatttaagttagattaagaaattataaaaaataaataaataaataaataaataaatttataggttaatatttttgatgaatattgatgtaaaaattttaaataaaatattagtaaattgaaattaataatgtattaaaaagattatgtattgggattaagtggtatttatttttggtatgtaaagttggtttaatatatgtaaattggttggtatagtggtttatgtatgtaattttagtattttgggaggttgaggtggatagattatagggttaggagttttagattattttagttaatatggtgaaattttgattttattaaaaatataaaaattagttaggtatttgtagttttagatatttaggtggttgaggtaggagaattgtttgaatttgggaggtggaggttgtagtgtgttgagattatattattttattttagtttgggtgatagtgttagattttgttttaaaaaaaaaaaaaaaaatatatatatatatatatatatatatatatatatatatatatatgtataatatatatatgtttaaattaattaatgtgatatattatatttatagattgaaagataaaaattatatgattatattaattgatatagaaaaaatatttaataaagttgaatatttatttttttttttttttgagagataggtttttttatgttgtttaggttggatttgaatttttgggtttaagttatttttttattttatgtttttaagtaggtgggattataggtatatatttttatgtttagtttaatattattttttgataaaaatttttaatagtttaagtatagaagtaaagttttggttaggtgtggtggtttatgtttgtaattttaatattttgggaagtttgaggagtttgagattagtttgtgtaatatggtaaaattatatttttattaaagatagataaattagttaggtttggtggtatatatttgtagttttagttattttagggaggttaaggtgggagaattatatgattttaggaggttgaggttgtagtgagttatgagtatgttattgtattttattttgggtaataaagtgagattttgttttaaaaaattaaatagtggtttatgtttgtaattttagtattttgggaggttgaggtgggtagattatgaggttaggagattaagattattttggttaatatggtgaaattttgtttttattaaaatataaaaaattagttagttatggtggtgtatgattgtagttttagttatttaggaggttgatgtaggagaattgtttgaatttaggaggtagagttgtagtgagttgagattatgttattgtattttagtttagtgaaagagtaagattttattttaaaaaaataaataaataataaataataaaatttttaaaataatgaaaaaaaataaaaagaaagttttttaatataataaaagttatttatgaaaaatttatagtaaatattattattagtggggagaaattgaaattttttttattaagatttggtataaagtaaggatgtttataattattatttttatttaaaatagtattggaagggttgggtgtggtggtttatatttgtaattttagtattttgggaggttgagataagtggattatttgagtttaagtttgagattagtttgggtaatttggttaaatattatttttataaaaaaaatataaaaaattaattgggtgtggtggtgtatgtttgtagttttagttatttgggaggttaaggtgggagaaatatttgaatttgggaggttgaggttgtagtgagttatgattatgttattgtattttagtttgggtaatagagtgagattttgttttaaaaaataaaaataaaatagtattggaagtattattaaagtaattagataagaaaaagaaataaaaggtttggtatggtagtttatgtttgtaatgttagtattttgggaggttaaggtgggtagattatttgaggttagaagtttgagattagtttgtttaatatggtgaaattttgtttttattaaaaaatatatatatatatatatatatatatatatatatagaaaaatagttaggtatagtagtgtatatttgtaattttagtaatttgggaggttgaggtgggagaattatttgaatttgggaggtagaggttgtagtgagttgagattgtattgttgtaatttagtttgggtaatagagtgagagtttgttttaaaaaaaaaaaaaaagtaagaaggaaggaagagaaggataaggaaagaaaagatatttaaattagagaagtaaaattatttgtttgtagatgatatgattttatatgtagaaaatttaaaagatgttattaaaaatatagatataataattgaatttagtaaagatgtaggatataatattaaaataaaattatgttatttttatatataaataatgatttagttaaaaatgaaatttagaaaataatttttttttttttttttttttttttttttttatagtttttttttgatgttgagttaaagttggattgtattgttgttatttttgtttattgtaatttttttgtttgatttttttgttttagtttgttgagtgtttgtaattgtaggtgtgtgttattatatttgattggtttttatatttttttggtggagatggggttttattgtgttggttgggttggtttttagtttttaattaagagtgatttgttagttttggttttttgaggtgttgggattgtagatggagttttgtttatttagtgtttaatgttgtttaggttggagtgtagtggtgtgattttggttagttataatttttattttttagttatttgttttggttttttaaagtgttgagattgtagtttttgtttagttgttattttgtttgggaagtgaagagtgtttttgtttggttgtttattgtttaggatgtgaggagtttttttgtttggttgtttagtttgggaagtgaggagtgtttttttttggttgttattttgtttaggaagtgaggagtatttttgtttggttgtttattgtttgagatgtggggagtatttttgtttggttgtgattttgtttgggaggtgaggagtgtttttgtttggttgttttatttgagaagtgaggagtttttttgtttggtagttgttttgtttgagaagtgaggagtttttttgtttggtagttgttttgtttgggaagtgaggagtgtttttgtttggtagttattttgattgggagggaggtggggggttagttttagtttggttagttattttatttgggagggaggtggggggtagtttttgtttggttagttgttttgtttgggagggaggttggggggttagtttttgtttggttagttattttgtttgggagggaggtggggggttagtttttgtttggttagttgttttgtttgggagggaggtggggggttagtttttgtttggttagttgttttgtttgggaggaaggtgggggggttagtttttgtttggttagttgttttttttgggagggaggtggggggtagtttttgtttggttgttgttttgtttgggaggtgggggggtgtttttgtttggttgttttttttgggaagtgaggagtttttttgtttagttattattttgtttgggaggtgtatttaatagtttattgagaatgggttaggatgatgatggtggttttgtggaatagaaaagggggaaaggtggggaaaagatagagaaattagattgttgttgtgtatgtgtagaaagaagtagatatgggagattttattttgttttgtattaagaaaaatttttttgttttgggatgttgttgatttatgattttatttttaattttgtgttttttgaaatatgtgttgtgtttatttagggttaataatggattaagggtggtgtaagatgtgttttgttaaatagatgtttgaaggtagtatgtttgttaagagttattattattttttaattttaagtatttagggatataaatattgtggaagattgtagggttttttgtttaggaaaattagagatttttgtttatttgtttatttgttgattttttttttattattgttttatgattttgttaaatttttttttgtgagaaatatttaagaatgattaataaaaaaaaaataaaaaaaagaaaaaaaaagaaaataattttatttatatagtattaaaaaaaataaaatatttaggaataaatttaattaaggaggtgaaagatttgtatattgaaaagtataaaatattgatgaaagaaattgaggagtatataaagaaatggaaatgtagttaaaattttaatggtattttttatagaaatttttttaatttaaatttaatatggaatagtaaaagattttaaatagttaaagtaattttgagaaaaatagagttggtagtattagattaatttattttaaattatattttaaagttgtagttatgaaaataatgtggtattagtataaaaataaatatatagattagtggaatagaatagagagtttagaaataaatttaaataaatatggttaaatttttaatagggtattaagaatatataatgtagaaagaatagttttattaataaatggtagtgagaaaattggattttatatgtaaaagaatgaaattgaatttttaattttatataatatatagaaattaatttaaagtggataaaagatttaaatataaaatttgaaattataaaatttttagaagaaaatatagggaaaaagttttttgatattggttttggtaataatttattgattattatattaataatttaggttataaaagtaaaaagtaagtgaataggattatattaaattaaaaagtttttgtaaagtaaaagaaataataaaatgaaagtttttttgaggtgaagttgtaaggtaaaaaaaataaaaatatatataagtaaatataataaaaaggtaatttatagattgagaaaaaatatattagataaggggttaatatttaatattttaaaagattttatataatttaatagtaagtaaatatataatttgatttaaaaataggtaaaggatttaaatagatatttttttgaagatgatataaaaatggttaataggtatatgaaatggtgtttaatattattaattattaaggatatgtaaattaaaaatataatgagatattattttgtatttgttagaatagttattattaaaaagataagagagatgataagtatttgtgaaggtgtggagaaaagggaattttttataataaatttttaggatgtaagtttatttatgtaataaatgtgtatttgtatttttgaatttaaaagttataaaaaaaagggaattttttttttagataagaaaagagaaaggtatagagtaggttttttgttttttgaataatattgttttttttaatattgttttattataatattgatgagaaaaaaaaattgaatttagtatatattgttttatttaaagttaatttttaattatttattaaggatattgagggtttattgtatattattggtagggatgtagatgggtatagttattatagaaagtagtatggagatttttaaagaaatttaaaatagagttattatatttagtaaatttttttttagatatttatttgaaaaaaatgaaattggtattttttatatatagttgtatgtttatgtttattgtagtattatttatagtagttagtatggagataatttaggtatttattaatgaataaatgaataaagaaattgtggtatatatttataatggaatattatttagttataaaaaggtggagattttgttatttgttataatatggatggatttagaagatattttgttaagtaaaataagttagatatagaaagaaaaatattgtatgattttatttatatgtggaatttttgtaaaggttaaatatatagagatagagaataaaatagtggttagtagtgttgggtaggagggaagaaatatgtaggttagaaaatatggttgggtatggtggtttatgtttgtaattttaataatttgggaggttgaggtgagaggattatttgagttagggagtttgagattatttttggtaatatagggagattttatttttataaaaaatttaaaaattaggtaagtatgtattatgtgtttgtagttgtagttatttaggagtttgaggtgggaggattatttgagtttaggagatagaggttgtaatgagttaagattatgttattgtattttagtttgtgtgatagaatgagattttgttttaataaaagaaaagaaaatatatgggatgaataagttaaaagattttatgtataatatgagatttatagttaataatagtgtattgtatttatgatttttgttatatgagtatattatagttgttttggaggggtgggtagggaatgggtaattatgagagagaaagaatatgttaatttgttttattatagtaattatttattatatatgtattttattatgtttatattttaaatatatataataaaatttattttataaaaaataaaattaaagttatttgaaatttttatattttaaatatatataataaaatttattttatataaaagaaagttaaatatataaagttatttgaaatttttaatgtttttagtttagttgtttatgaaaagtaatagtaaatttttattgaagagagatgatagtatttatagttttaaaattatttttataatttttattatattattattgatattttatataaaataatttggtatttaagtggataagatttgattgagaaataagagaaaaaatgagtattagaaatagattattggataatgtagtagttattaaaataagaaagtatatttgttggtagtatatattttgaaaattagaaaataaaaataatatataaataaataaaataagagagtataggttaggtatggtggtttatatttgtaattttagtattttgggaggttaaggtaggtggattgtttgagtttaggagtttgagattagtttgagtaatatagtgaaatttatttttattaaaatataaaaaattagttaggtgtggtagtgtgtgtttgtagttttagttatttgggaggttgaggtaggagaattatttgaatttgggaggtagaggttgtagtgagttgaggttgtgttattgtattttattttagtttgggtaataggggaaattttgtttttaaaaaaaaaaaaaaattaaaataaaataaaataaaaataagagagtataatgtgtaaatggaattaaaaaatagaattgtattagagaaaaagaattataaaaagagttataataaaattgtagaattgaaaaaggtaagagatgaaattaagattttaatggatggtttaaaagatgattataggtataagtgaaaattattggtaatatggaagttaaagaagattatgtttagattgaagtgtgggtaaataaaaagatggaaattttggaaaagaatgtaagagatagatgagatataataaaaagttaaaatatttatttttatagttttagaaagaaagaataaaaaagggtaaaaataatatgtggaaaagtaataattaagagtgttttaaaattaataaaaggtagagtatggtggtttatagttgtaattttagtattttgggaagttaagatgggaggattgtttgaatttaggagtttgagattagtttggataatatggtaaaattttatttttataagaaattttaaaaaattagttggatatggtggtgtatgtttgtaattttagttatttaggaggttgaggtgggaggattatttgagtttaggaagtggagattgaagtgagttaagattatattattgtattgtagtttagataagagagagagagagatgttgttttaaaaaaaaaaaaaaaaaaaaaaaaattaaattaataaaagatattaagttatagattttagaagtattataaattttaataaggataaatagaaaaaaattatatttagataaattatagtaatattgttgagagttaaaattaagaaaaaatgataaaaatagttagtagggtttttttgtttgtttgtttgtttgtttgttttgagaaggagttttattttgttgtttaggttggagtgtagtggtataattttggtttattgtaagttttgttttttggtttatgttatttttttgttttagttttttgagtagttgggattataggtatttattattatatttggttaatttttttgtatttttagtagggatggggttttattatgttagttaggatagttttgattttttgattttgtgatttgtttgttttagttttttaaagtgttgggattataagtatgagttattgtgtttagttggttttttattttatatagttaaattatatttgttttaatgttttaatgatttattaattttattattatttatgaagagaaatgaaaatatatgtttataaaaaaaaaatttgtagaagaatgtttatagtaattttatttataatagttaagaattgtaaattaattatattagatattaaggtttgttataaaattataggttataaaaagtatgttattggtaaaaaataaataaaaagtttaataaaatagaagatttaatagaaatagatttatatatatttagtgatttaagaagatgatattatagaataatagagaaaagatggtttttttaataaatggtattaatttgatatgtttaggaaaaaaaatgaatttttatatatatatatatatatttttaattgtattattatagatttgattttaaatggattaaagattattatggattgaattgtgtttttataaatttatatgttgaagttttaattttagtattttagaatgtgattgtatttggagataaggtttttggaggtggttaaaataaaataaggttgttagggtgggttttaatttaatttgattggtgtttttatgaaaagagaatatttggatatatgaatagatattagaaatgtgtatatgtagaggatgtgtttgtgtgtttgattttattagttaggaaaatttaaaaggaaagtataaggagatattattgtatatttattataatggttaaaattagtaagattggttaagtgttgaatatgaagagtaaagagaatttttatattttgtaaataaagtatttataattttaaatttatatagaagtatttatagtgagaagtataaagttttttgattttaatatgaatattatttttaaaaatattttatttttttttgaataaggttaaattttttaagtagtttatttttttttttaattagtttagaaagtattagagtaagtttttttttttgttttaaaaaagttaagttaatattattatgagtaaattattataagtttttataatataataatgagagttaaagtagaaaaaagaatttatttatataaagttgatttttaatttgaaataaatttttaataaaaattatattaaaataaatatgtttttaagtaaattaatttatttaatgtttattgttaatttagaaatataggttttttattgtttttgtataaatataagttaaaagtattttgtttttaatgagaaaataaatgtttttttttttttttttttgagatagagttttgttttgttttttaggttggagtgtaatgatgtgattttagtttattgtaatttttattttttgggtttaagtaatttttttgttttagttttttgagtagttgggattataggtgtttattattatgtttagttaatttttatatttttagtagagattgggttttattatgttggttaggttggtttggaatttttgattttaggtgatttatttgtttgggttttttaaagtgttgggattataggtatgaattattatgtttagtttaaatattatttattaaagattttttattgaagatttatattgtgaattagtatattaaagattttgaaataattttattttaaagatatttgtttaattttatttaatttattgttttttaaataaatttgattttaaaaaaataattttaagaagtttttattattatattttttgatgttaatatttaaaataaaatagtttgagaaatgttattatagggttatagatttgaattgattaaagaaatagtaaattaaattttttttttttttaattttttttttaaataatgaagtaggtgggaatttatttgtaaaaggattagttttagggttgaggtaatataaataagtagaaaagaaatgaggattttaattatttatagaatatggatagagataaaagggaaaatttttaaaagataagatattttataatgagtgtagatgaagaatagattttagttttttagattaaggaatttttaaaaggtatagaaaattataaagaaattgaaaaatagaagttaagagatagggaagttagaagtaaaaggggtaatatttgaaaaatagtagttttaaaaatgtattaaaaattttttaaaattaggttaggtgtggtgattaatgtttataattttagaattttgggagattaaggtaggtagattatttgaggttaggagttttgagtaatatagtgaaatttgtttttataaaaaaatataaaaattagttaggtatggtagtgtatgtttgtagttttagttatttaggaggttgaggtaggagaattgttttagtataggaagtagagattgtagtgagttgagattatgttattgtgttttagtttgggtgataggagtgaaattttgttttaaataaaattttttagaattaaaaaaaagatgaagttgggtagagtgatatggatttgtgtagttttaattatttaaaaggttgagaaaggattgtttaagtttaggagtttgaggttgtaggttgtaggtgtattataattgtatttgtgaatagtaattgtattataatttaggtaatatagtgagattttatttttttaaatataaatatatatatatatatatatatatatatatatatatatatatatatatatatatatatatatatatatatatatatatatatatatatatatatatatatatatatataaaagattttatattaaaagattttagttgagtatggtggtttaaatttgtaattttaagattttgggaggttgaggtaggaggattatttgagtttaggagtttgagattagtttgagtaatataagatttttatttttttatttttgagatagggtttttttttgttatttaggttggagtatagtgttataattatggtttattgtagtattgattttttaggattaggtaatttttttattttagttttttgagtagttaggattatagatgggtgtttttatgtttagttaatttttgtattttttgtagtgatggggttttattgtgttgtttaggttggttataaatttttaagtttaagtgatttttttgttttggttttttaaagtgttgggattagaggtgggagttatagtattgggtttgatttttatttttgatttttattttttttaaaaaaaataaaaaataaaaaataaaaatttttgaatttttatgtagtttttaatttgtttatttaaaataataaatatgttttttatattatttgtttagtttagtgataaaatgaatatttttttagtatagtattggttatttattgatttaaaatttttttataaaaaaaagagaatagtaaaaaatttaataatagttgtatatattattaatttttatggaaaattataaagattagaatttggttttatatttttaggtagtgttgttataatttttaagataaagaaaagtaagtttttaaaaatgtatttttggtaaaaatattgattataaatataggtataagtttatgtggttaatataaaatgggttgttagattaatattaaatagaaagtattagagtatatttttttgttaatttttaattattattgttaagtaaagaatagtagtatggtgaaatgtaattatttttaaattggagttttatagaggtgatttaaagtttttaaggatgagaataagagaaggttaaagaaagaaattgagtgatttagggtttaggtatttttattttgattttaattagtttaggttttatttgtaaagtataattagttttttaatatataatttttttataggaagaaaaaattaatttgtagttttaaaaataaaaagtttgatttaaagttagtttgggtaataaagtaagatttgttttaaaaaataaaaataagttttgaatattattgatagagatttgggtttggagtttgaatttttttattttatttttgtgtgtttttttttttaagtgtaatgagaataatgttgtttgaatatgttagataggtgtttaaaaaagggtaattatttatattattttttttaaagattttgattttttgattatggtttttttatattatttttttttatagtagatttttagtataatatagtttaaggtttttgttgttgtttttatattttatttttttttgggttagtttattatttatttttatttaatggggttattttgttttttgttattaggtttaagatattatttgattaaaaagaaaaggggaaaggtaaggggaaaaaagaaaaatgttattttaagaataatttgaagtatgatggggtttgattttttttaggttttaatttaaaatttttatagtaaattttttttttaggttttttttgtttataagaatagtgtttaatagttatttttttttttaaaattttttataattttaatttaaatatgtattttttttaaggtattatttatattttataatttgtattaaataaatttgattatatttttaaaaaatatttttttattttgatttttgtttttgtttttttttatattattttaggtattagtttgtagaaatttaatattattataagtaattaatgataaaaaaaaattatttttgttattgggggaaaaaaggtatttaatatataatattaggaagaaaagttttttttatagtttatatattttttaagtattttatttttagttaatgtatttaatatataagatgtatattaatttaaaaattgtgtaattaatatgatttatgatattttattttaaaaggtaattttaaaagtattttttagattaaatatgtaattatttttagtataataatattttttagatttaattatattttattagttttttttttttaaaaggatatggtaaattttagtttaaagtattgagttagggttgggtgtagtggtttatgttagtattttgggaagttaatgtaggtggattatatgaggttaggagtttgagattagtttggttaatgtggtaaaattttgtttttattaaaaatataaaaattagttaggtatggtggtaggtatttgtagttttagttattagaaaggttgaggtgggataattatttgaatttgggaggtaaaggttgtagattgtattattatatttaagtttgggtgataaaataaaattggattttgatatatatatatatatatatatatataaaggattaaggaaatatggaaattaaggaataatttaaaaaaaaaaaaaatttttttttttttttgagatggagttttattttgttgttgaggttggagtatagtggtattgtgtaggtttattgtaatttttgttttttgggtttaagtaatttttttgttttagttttttgagtagttgggattataggtgtttattattatgtttggttagtttttatatttttagtagagatagggttttattatgttggttagattggttttaaatttttgattttaggtgatttatttgttttggttttttaaagtgttgggattataaaaaaaaaaaattttaaaaaaataaaataaaataaagttttgagttggttagatttggtagattggagaaaagtaaagaatttgagttttggttatgtatggtggtttaggtttgtaattttagtattttgggaggttaaggtgggtagattatttgaggttaggagtttgagattagtttggttaatgtggtgaaattttatttttattaaaaatataaaaattagttgggtatggtggtgtaagtttgtaattttagttatttgggaggttgagatataagaattgtttgaatttgggaggaggttatagtgagttaagaatatgttattgtattttagtttgggtgatagagtgagattttattttaaaaaaaaaaaaaaagaaaaaaagaaaaaaagaaattgagttttaaaggatttattttaaatttattgttttggtttaaattattttggtttttttaaggagattttttatttttaaattttatttataatataatattttattttataaaaatatagaaagaataattaaattttttaaatattaataaatataatatagaattatatgtaatttgataaattgaaatttaaagggtgatgggtaatttttttaagagtaattttttataaagtatggtagtgattaattatagaatatttaaaatttattttatttttaaaatatgagtattaaaggagtttaagattaagtagttttaaaaaaaattaattaattaggttgataaaatatattaagaataaattaaaattgttttttatttaattttaaatatgatatatattaataataaaaagaatgttaatatgtagattttgtgaatatttgattataatataaagttttatgaaggtatatttttttaagataaaatattaatattaattatttttaaattttttttaaatatagaggaggaagaaatattttttaatttattttatgaggttggtatttattttaaaagttagataaatatattatataagaaaagaaaattatatattaatatattttatgattttagatgtaaaaatttttaaaaaaatattgataaattaaatttagtaatatataaaaaggattatgtattatgattaagtgggatttattttagaaatgtaaggttggtttaatatataataattttatgaattatattaagaaaatgaagagaaaaaaaaaatgtatgattattttaatagatatagaaaaagtatttgattatatttagtattgttttatagttaaaatatttaataaaaattagttaagtatgatggtatatgtttgtggttttagttatttagaaggttgaggtgggagaattatttgtgtttaggaagttgagatggtagtgaattatgattatgttattgtattttagtttgggtaatagagtgaggttttgttttaaataaataataaaaaaaataaaatatatttaataaagtatgatttgagggaatttttttaatttgataagaaatatttatgtaaaatttatagttaatattatatttaaagatgaggaaaaaaaaaaaaaaaaagttttttttttaagattaggaataataatgtttgttttattaatatgtatttaatattgtaatggaggttttagttagagtaattaggaaagaaaaataaataaaaggtatttagattggaaaggaagaagaaaaattgtttgaagatgatataatgttattttatatatagagaaaattttaaagaatttatagaaaaattattagagttattaagtttagtaaagttgtagaatataaaattaatatagaaaaattagttgaatttttatataatagtaatgagtaatttgaaaatgaaataaagaaaatatttttatttataatagtattaaaaagaataagattattaggaatatatttaataaaagaagtgtatattgaaattataaaatattgtggaaagtaatgaaggaagatttaaataaatgtaaagttaatttatgtttatgggttggaagatttttttgtttgaaatagggattgagtttgttatttaggttggagtgtagtggtgtgattttggtttattgtagttttgttttttttaggtttagatgatttttttattttagttttaagtagtaggattataggtatatgttattttgtttaattaatttttgtattttttttaaagataggattttgagagtggtaggaggtagttaaatgtttaggtagataggggtgggtttttagtgaaattttaattttaagttaaagatagtttaaagtttgaaagttaagttataagttaaatttttggattagattgagaatttgtttttttgtttggtttatttttttttgattgatttttattttttatttattttatatatatttattttttattaataagtttttttttttttttttttgggatggagttttgttttgttatttaggatggagtgtaatggtgtaattttagtttatggtaatttttgttttttgggtttaagtgatttttttgttttagttttttgagtagttgggattatagatgtatattattatgtttagttaattttttgtatttttagtagagaagggttttattatgttggttaggttggttttaaatttttgattttgtgatttatttttattagttttttaaagtgttgggattataggtatgagttattgtatttggttttttaattagttgtttatattgttatgtttatttttaagtggtgtttttgttttaattttttttgtatatttataaattaattagtatgtattttttattttgagtttataaaaggttgtagatttagttatatagggggatttttttgttttttggtaggggaattattttttgtattttttttttgttgagagttttttttttatttaataaattttattttatttattttttggggtttgtatgtttaattttttttggttgtgagataagaatttggatttagttgagttaaggagtagaaagattataatagttttattaagttgtttgggttggttttgaagttttgggtttaaatgatttgtttattttggttttttaaagtgttgggattataagtatgaattattgtatttagtttggaagatttaatattattaagagagtaatattttttaaattgattaatagatttaatgtaatttttattaaaattttaattgttttttttgtagaaatggataaattgaattttaaatttttaaaattgaatttttaaaatttatatagaaatgtaagggattttatatagttaaaataatattgataaagaaaaagaatgtggataaataaaaataatgttgggggatttatatttttttattgtattttattataaagaaataataattaagatattgggtaaaaaaatgttttaaagataatgtagtaatggtatagggatagatatagattaatgaaatagaaattagagtttagaaataaatttttaaatttatggtaaattatttttaatagtattaagataaattaatgagaaaaaaatagtttttttaaataaattatattagaataagttaataaatatttatatgttaaggaatgaatttagatttattttttataatatatatggaaataaaattatttaaagtggattgaagaattttttgtaagagttaaaatttttagaaggaagtataattgtaaatgtttgtaattttgttttaagtaatggttttttagttatgatattaaaagtataagtaattaaaggaagaaaagataaattagatttaattaaaatttagaatgtttatgttttaaaggatatattaagaaggtgaaaagaaaatgtatagaatgagagaaaatttttttaaattatttatttggtaagtatttagtattttaaatgtataaagaatgtttataatttaataataaaaagattatttattttttaaatgagtaaaaggaaattaatagatatttttttaaagaagatataaataataagtatatgtttaatattattagttattaggaaaatataaattaaaataattataaggtttggtgtggtggtttatatttgtaatattagtattttggaaggttgaggtaggaggattttttgaggttaggaatttaaggtagtagtgggttatgattatgttattatgttttagtttgggtaataaagtaagattttattttttaaaaaataaaataaataaataataataataataaaaaatagagtaaagttgggtggggggatttatatttgtaatttttgtattttgggaggttgaggtgggtggattataaggttaggagattgagattattttggttaatatggtgaaatttgtttttattaaaaatataaaaattagttaggtgtggtggttagtgtttatagttttagttatataggaggttgaggtaggagaattatttgaatttgggaggtggaggttgtagtgagttgagattatgttattgtattttagtttgggtgatagagtaagatttagttttaaaaaaaaaaaaaaaaaaattataatagagtgaaatattatttatttgtatatttataagggtggtaattaaaaataaaagaaaatagaaaattataagtgttggagagaatgtagaaaattgaaatttttataaattgttggtggggatgtaaaatggtgtgatttttggaaaataatttggtagtttttaaaaagttaaatatatggtaaatatgatttagtgattttatttaggtatttatttaggagaattaaaaatatatataaaaatttatatataaagtagtattatttataatagttaaaaagtattaataatttatatgtttattaattatgatataaatgtgatatagttatataatggaatatttttttattataaaaagaaatgaagggttaggtgaagtggtttatgtttgtaattttagtatttttggaggtttaggtgggtagattatttgagtttaggagtttaagattagtttgggtaatatggagaaattttgtttttataaaaaatataaaaaaattagttaggtttggtggtatgtgttgtggttttatttatttaggaggttgaggtgggaggattatttgagttagagaggtttaagttgtagtgagttgagattaagttattgtatttttttttgggtgatagggatgagattttgttttaaaaaaaaaaaaagaaagaaaaaagaaatgaagttttgttatatgttataatatggataagttttgaaaatatgttaagtaaaagaagttagataaaaggttatatatagtatgattatatgatatatgtagaatagatatgtttatagagatagaaaatagattagtggttgttaagggatgaggggtgggaattaagattgttaattagtagagtttattttttggggtaataaaaatgttgaggaattgtgttgatagttgtataatatagtgaatttaataaaaaaagtattgaaatggatattataaaaggatgaattttatgttgtgtgaatatattttaatataaaataatttttaaaaataaaaaaaaaatttaaagtggaataatgttgtgttattttagtttttaggttagggtatttgtatttagtaaaaaaaaaaaaaaaaaaaaaaaaattgtgtaggtgaagatataatgtattagattagagaaaattgtaaaatttggttgtatttttttatgtatttttgtatttttttatgtatattggtagttttataaaaattaaattttgattattattgtttttagtgaagaaagggaaatatgtttttttttttaaaaattttatttttatgaataagttattatagttagaaatttgggagtttttttagatttttttttttttattttttatatgtaattaataaagttaaatatattttagtttttagaggttatttttttatatagtatttttttttttatttttattattgttattttttttttaatttttattttaagttttgtttttttaatatttaatttatatgttattattaagaagagtttaaattttaaattataagtttaattatggaaaagtttttaagagttttttaatatttatagtatttggaatttatttatatttttggtaagtattattgtttattattttttaagtttattttatattttaagtaatatagtttttagttttttgtattgtgtgtgtatgtttaggtaagtattttattagtttttattttgtattatttttttttttgtttttttttttttaatagataatatgatgttagtggttaaaattaagttttagtttatttagaatttttataaaggtgttttttttatattaaatatatatatatgtgtatgtattagataaattatgaatttataaatattatggtaatattatttttaatttatttaataagaaaatataattgtaattgttttaataattaagtggtttttttaaagatttaatttagtttttaaaaatatggtgatataaatgtttttatatatgttaataaagatatttagaaatatttaaggagaaaaatttttataatttgattataaattagatttgaaaaataaaaaataaaatttgaatattgggagtttattatttttagattgtatattaataagatagaagtgaagaataattttatttatggtagagtattttaaaagggtatttattttttattaaaaaaaaaaaaaatgtagaattaaaattttaattttttgtttaattttaggtgtttttttaaggtttaatgagaagttatattagtaaatgtaattaatttaaaggaatagtttttaagttttttatagttgaaggaattatgtgtttttgtttaaaataaataatatagtggaaaggttaattagttttaggaattgggaaatatttatatttttgtaaagtttagttaagtaagtgttttttttatttttttagagttttaggtttttttttattatataaaaattatttaagtgttttatgagtttaattattgttttgaatatgggtgggagttgggtagtagatgaggattggttttgggatttttgattatggtggtttagattttaaagttggtttattgttttttttttttggtggtttttgtgatttttgggttatgtaatatttattgtgtttgggtttattttgtgtagtttttttaggagtagttttaaatatggttgaggggtaattttgggtttttttatagtgttaaagttgtttttgtggttgttatagtaattttggtttgttggggttataataaatggtggagaatatatagtttttggtttggaatttgaatttgtatttggtaattggagtggattattgtggagttggttgtggggggagttgggggataggggtatttgtaggttttataggtttatgttgtttattttgatttttttgttatattttatattttgaggtagtgtaggtttgagtttgatttgtataagtttgtgatgtattttgtttttgttattttattttttggtttggttttggttgggtagttgtgagaaggtggggaggtgtggatagttgtaaatttttttttttttgtgtaagttttgtagatgtgtttgggttgtttgtttttaaaggggttggtgttttatttggtgaagttatttagttttggtagtggagaggtttgggattagaggatgagatttggttttatattttgtgttgttgtgtgagttgtataattttaaagattagggttatgttttaagggtatttgttttgggtggttgtggtggtggtggtggtgagattttttttagaggtgttttggtgtaatttttatttttttgatttaggggttgatgttaggtttagttttgatatttaaggttttttttttgtagttttgttggagtttgttgtttgtgttttgtagaagttttgatggtggtgtattttgggagattttggtagttttgagaagttagttgttgttgttattttagttagaaaaatggtttgtggggtatgtgttggtgtgttttgttaattatgtttggattttggattttagataggaaggtgttttggtttagttgtggtttggttagagtttaatttgttttatgtaagagaattttgatttggtttttttgtttatttgagttatttgggtatttgttaggtttagttgtttttagttttattagtggttagttatttaaatgttaaattaaatttttgtggattttggtttggtgtggtgtgtgttgtttttttttgagaagaggagttaaaagtagtattttgttttttaaatttaggattttatttttaggattgttgaataaagtgttaagtgttggatttgtttgtaggagatggttttagttgatgtaggtgtaaaggataatttattttatatatatgttttttttgttagtatgattatttttattatattttgtttttttatttaagtattttggtgaagtaatttaaaaaggagtagatatttttttttaaataaattatttaaaagaatttaatagatgaataaaattttaaatttttaggaaatttttttgatgtaattttttgtagtaatgaattgttatgttatttaaaaaattaaaaattggtttaagtttatagtaagtgattttttaggattaaaatgtggtttagttttttagaatttaagattgttattttttttttgttatattagtttgaggagttttaggaaatgttaatattagagtagttaaaattgtttagtaattttttattgttaaggtataaggtattatataatttttatatgtgttagatattgtgtattaaaattatgtgaatagtttattaaagttaaaataagtataattaaatttttatttttagaattttatagatttttagaataatgtgtatgttttaattagaatattgtattatttaataaaaatttttaaatgtgtttgaatatttttggaagattttagaataatttttaggttttagaatttttaaaaaataaaaataaaaaaaaaatttttttttgttttttttaagttattttatgtttttttttaatttttagtaattattattttaaatattaaaaatattaaggatagaggataaaatgaaaaaaaaagaaaaatttaagttttttttatagtaaaaatatagtaaagtttaataaatttagtgtaaaattttaaattttatttgttttagtatgtttaatagttataaatttatttttttttttggattttttaattttattttttgaaaagtttatgttaaaattttttaatatgtaaataaagttttattaggtattttatatttttgagaaagattttagattttaatatattttgtatttttttgtttttatattgtgattttgttttgatatttgtgtggtaaaggggtgttataggtggagttgtgattattaatttataatttaattttatggattttatttgttgttaagtatatatatatatatatatttatatatatatatatgtatttatatatgttttttaaaatgtatatattattatttttttataatttataattgaaaagaaaaattttgaatttgataattgataaaaattaaaatgttttattttatagtttatttatatagagtatatgatttttattatttaaaagatatttaaagattgttttttataagtagatatgggaattttttggttttatatagtatttgttttaaagtagatgttagaataaatgttgttagtgtttgtgatagatattagaaaatatttaagaatattggaaatatgttaattagtaaattttgtttataatttagatattgattttttttatgaagggttttattgtaaagttgtaagtattagttatttttttttaattaaataggtagtgttatagattttaagatttatttttttggaagaaaattaaaattgtggagttatatttttaatttttgtattagtgatgtaagagttgtttttagaatatattgaattaggaattatttgttgaataatagttggataatttttattgtatattttgtgaataaatgaagtattttatttaagaatatataaatattagaatttaaagaggttttttaattgtaaaatagaaaaaaaagtagtgttaaaaatagaattattatttgatttagtaatgttattattgggtatatatttaaagaaagtaaattgttttaataaaagatatgtgtatttttatgtttattgtagtattatttataatagtaaagatatggatttattttaggtgtttattaatggtgtattggataaagaaaatgtggtatatatatatgatggaatattatgtagttataaaaaatgaagttatattttttgtagtaatgtggatgtagatggaggttattattttaagtgaattaatgtagaaattgaaaattaaatattatatgtttttatttataagtggtagttaaattttgggtatgtatagatataaagatgagaaaaataaatattagggatttaaaaatgaggaagggagtaggttaaggattgaaaaattttttattgaatattatgtttattatttggatgatagaattaatagaagtttaaattttagtattatgaaattaatttttgtaataaatttgtatatgtattttttgaatttaaaataaatatggaaataagaaagaaaggaagggttgggtgtggttggtttatatttataattttagtattttgggaggttaaggtgggtgaattatttgaggttaggagtttgagattagtttggttaatatggtgaaattttgtttttattaaaaaatataaaaaattagttgggtatggtagtgtgtatttgtaattttagttatttgggaagttaaggtaggaaaattatttgaatttaggaggttgagattgtagtgagttgagattatattattgtattttagttttggtgattgagtgaaattttgttttagaaaaaaaaaaaaaagagagagagagagaggaaggaaggaaaataaaggaaaagagaaaataagaggaaaggaaaggaaaggaaaggaaaagaagaaagaaaagaaaagaaagatgttgggtatgatggtttaagtttgtaattttagtattttgggagattaaggtagaaggatttttttgagtttaggagttttagattggtttgggtaagatagtgagtttttgtttttataaaaaatttagaaaaaaaaaaaaaagaataatttattaagattaagttggttttatttttgggatgtaaggttggtttaatatatataaattaataaatgtaatttattatataaatagaaataaagataaaaattatatgattattttaatatatgtagaaaaggtttttgataaaatttaatagttttttatgttaaaaatttttaataaattaggtattgatggaatatattttaaaataataagagttatttatgataaatttatagttaatattatattgaatgggtaaaaattggaagtattttttttgaaaattggtataagatagggatgtttttttttattatttttatttaatatagtgtttga

SEQ ID NO: 69 - DNA, 20506 bp, Artificial Sequence
  chemically treated genomic DNA (Homo sapiens)
gtttttttagagaaatgttttgtgggaagggtttgaagtataggtgatatgtagagtagagagggtttaggaggaaggtaggagatgatggtattgttaaatggtgaagaagatgaggttagatgtgaattgggaaagaatttttatgtttaggattggttattttgtggattgggttttaaaaattaaaaataagttgtgaatgtttgttttttttaagtagtgttgggtttggttttagtttgaaggtattgatatgtgagggagtattgatggggtagtaattttttggggttaattttggtgtatattgaatttttttgggttttgtttatggatttattatgtttttgtgattagtgggggaattaaggtagtttattttaaaggattatggttttgattaggattgtatttaaagggtttaaggagtatttttttgtttagtggttgtatagggggaatagtgtatgtattaagatattggttatagaggaggatgttggttttgaataaaaatataggattggataatggataatattttaaataagatatagatgtgtatagtgtttttaggtaatataagatatttttattttttgtttggtgtatagtttatatgaaagttttggttttgagagtttttttgtagggttatggagatagttgtggatatatatgatgatggatgagatagagaatgatgagtagaatgtggaggatgtggaggtgtttgggatgagggttgggttttattttgttttggttttatattgttgttttagtttagggtagttttgttgtttttttagaagaggtagatttggtttttatgtggatggagaagggggtgagttttttatgtggttttttattattttattttatagagagaagtttttattaggttttgtttaggttgattggttttggtatttttaggtgttttttttggtggttttttattttagggttgattatggggttaggtttttttagtttagtttttttatttgtatagtttagagaatataaaatttaggagttttgagttagaggagtggttttgtggaaagatattttaataaggtaagtataataatggttttagtttaagttgttatgtgttgttagtgatattgaataattaaattaaatgaaaaataaatgttatgtattttgttatataattaaatggtgaaaatatggtaaagtgtgtaaaataaagtttttggtaatgtttggggttttgttttggtaggggaggttgtggtaggtttttttttaatattggttttagagttgggtttttattgtaagggttttttaggtgtttgatttttttatattttgaattttttgttgataagaatagagggaaatattattaaggtaggttttttttatatttagttagttttagaaggatagtggtttgtgtggaggttttggggttaatttttatttttaagttgttattttggttatgtatttttttttagaggttttgtgataatagatgggaggggagtgtgagatgtagttaggttgaagtggagggatttatggatggtagaaagtagaggatagatatgtggtaagtattgggtgtggtagatgtatgaaggtatagagaggtttattagagtggttatatgatggggatagggtatattgtttatttggtattggtgtggggttgaggtttaggatgttgttgttttgtattttggttttggttgttttaagaggtatttttgtggtttttagtaattttttgtttttggggttttttagttaggggttatgttattgtaggtggttttaggtgggattgttggaggtggtataggggtgggtgtataggtggttaggattttttaggaggaatgtatgttggatagagtagtgattatagtgtattttttatttggttttgattggtgtgagtattttttagttttaatttattaggaattttggttaggttttttatttttttatggtgattttgtttttagtattgggtgtattatttgtttttaggagttttataagttatttgtaaattatagtgagtttttagggtatatatagttatattaagatattaagataggatggattttgtatgtgtttttaaggtgggatttatttttagtttttgtagattttgttttttaggagtgggatagtaagtagtttgtatttttaggtagttttagttgggttttttgtttttagggggttaatagttttttatattgattaggatagattggttatttttttttaggtataaagttttgttgtatgtggagtttgaagaatgtaggtgagtatgggggtataggtttgtttttttggggtgtttttgttaagagttttatggattagagtggttattggtttttatgggaaggatggtagttttaggtagtttatttaatagttttgtgttttaagaggtggggagggtagaagattagggtatttttgtatttagggtttaggtttgtgatttttagtgttggtaagaggaatgtgggttaggagagttgtttaggtaaaagagatagtagtgggaaataaaggtttttggttgaagtattttaggatatttttttaatgaggagaaggtatggttgtgattatagggagtttattaaagtttaaggggatattatgttttgggatagggtgtgtttgatatgtaggggtttttgtgggtttttttttgaattttatgtgttttattttttaattattttttttttttgtatttattaaaattatgatttaggatttgggtgtagggtgggtgggtgtttatgtgaggtggagaagggttgagaaatttaatgtattttttttttgagtattattgaaatggggtttttgtttttttatttttttggtttagattagagaaatttgttaaaaaattttatatatatatttatatgggtagggaaggagggtgtaggaaagtttttagagtttaagtggtatttgttttaggtagataaggtattttttatgaatgaggatagaggtagttgtgttttgtagttggagtatatgttattatgtaggaggtgggaggggataggttgggatttttagggatttaggatttttgtaaagttttatagtatatttgttttttatgtgggggatttgtttaaagattttaaagagaattgtttaaagaggagttttttgagaagtgtttttatatttgttttttgagaatgtagtatttttttgggtttattttatatagtttgtagaaatttatttgggtttggggataaagttatttttataatttaggaaggaggggttgaagaagtttttttttaggtggtagagtgttggagggaaaggtaatgggtatttggaaaaagttagggtttatttttaagggttagttagtttttattttttttgagggttatagaggggtggtatattttttttttggtgaggttatttttgttagtaggttgttttgtatattggttaggtggttatagtttggtttttataggaatgtagattgtaagtgtgtggagttggtgagttttttagtgagtgtaggttttttaagagaggaagtggagggtgggttggggggtttagtaatttgggtatttttggagtttttaggttattttggatagagttttgagtatataggttttgtgttatagatttttgttttagtttttgtataattattttttttataatttagtagattaataagggttttaaaaagtatataaatatagaagttggtgtggttggtagggtagtaaagtattgtttttttatggaagtttgagtttttgtttagtttgtatgggggtttgttttggaggaggattgagtaaatttataaagtgttgagagtaagtgaattgtggtttattttgaggtggtagataattagtttttttttttttgggtagtttttttttttttttgttgtttttttttttttatttttttttttttttttatttttttttttttgtgtttttttagataaaattagtagaattattaataatgtggaaataaataaaagtttgttttagtttgtataagatttaatattggtttgtgtattggttaaattgtgtttttagttttaggtttggaggtttttggttaaagtattgtttattagtaatttattaaaataaattggatatttttttttatttaaataaatgtttaatgggtttttagaatatttttgtgaatgggttatagtgattgttaatttgttaatttgaatttgatttttattggggataaggaatttatattttagggtatatttagggttaggttggttattgtggtttttgttattttattttgttttgtttttatgggatttttttttttttttaatgtagggttgaatttttagttttttttaagaaatgtttgtattttaaattgaataatgttttggaggttgtaggttttaggtttagattgttatttagaagaggagaaaaaaggtagtggttttatttttttttttttagatgtttgtgaatatttttgggaatgaatgtgattgttttggagagtaagggagagagttggttagtagaattttattagagtaattggtttgtgattgttatattaaaatgatttaagttgaatggtatttaatgatttatggggtgaggttatttgtttttgtgaaagttttatattaattatggtttggagttatgggatttttatatgggaaaatgtaaaaggttgatattattagggttgagtttttggggattatatggggaagttaggagaattaaggaggaggagggagggaagatgaattagtgagttaaatattattttttagaaaattagtattgttattttaattgggttaaaaaaaaaaaaaaaagatttaaaaatttgagttgtagatttaatttgtttgtgagaaaagtttatatattgttatatatgggttgtgagaaggggttttagatatttgattgtaggtaggtttaattatataaattagaaatgtttataagttttattattaataattaatgaattttattttaggtaaataaatttttatatatagtaggatgtttatattatgaaataattagtattttattgttagtgtatataatgttatatttgatataattttagtataagtgaaaaaatatattgtggttaatattgaaaagttgtaattatatttatatattatatatatttttttataaattgttagtagtttgagataatagagaagtataaattattgatatttatatggttttattttaaatatatgaattgtttgattataaatatattttgaaatatatttgttttttaaagaaatgtaaaaaaaaatgtgtataaaaatatatataaaaaaatgttttgtaaaaagttataaatattattaggattttttgtggattgtatttatgtatggaaatgttattttgttaatagttttgattggaatttgaaattttgttgtggttttaggagggggtagtggtaagatgatggtttatttattgatttttttgtttttgattttggaaattttagagtttgttagtgtttttatggtatatataggttttagaggtaattataaaatttagttatttaaagtgagtttttagatttaaaattgtatttgattttgtaaagatttgttttttgtgggtaagtagggggattattatatatttttaggagagggttagttttattttggaggaggttaaagatggattttatagagggtttgagttgtggggtaggttttgggaggagagggatgtagggtatgagttttagtaattattttttttttggttggtgtggtgttgattaggttatagaaatgagaagtagaagtaagattaagtatgtttttggagttggggagagagtaggaatagttgggagaggggtttttgagtatagttttagtaatagtggtttttatatggagtttatagagttaattattgaggttgaaagaggaggtgaaggtagtggtggtgtttagttttagttggtatttgagtgttatagaggttttttttttgggaggggtgttgttgtgggagttttagtgtttgaagaaaggatattttttttagttttttgttaagttattatttgattgtgtttagattttttaggggagtagaggagatgttttaaataagttaaatttagattttgaagtatttgttgatttaaaaaatgagaatgagaatgatgatgattgtgatgattatgaaggaattaattgtttgaaaatgttgttgataatataattttttttttagaaaaattttagtaataaaagttttaatgtgtataggtatagggtatggatgaatataagttgtaatattatattgtatgttataaatgtagggtttaaatgttggtaaattttaggtttgattttagattaatgtgtttattttatatatatatttggtttttatggttaaggtttttttttttatgtttttgtttttttattttttataaggttttagttttttttgagtgggtttagtggaaagttttttttggttgttgtgtttatttgtttaaagttttttttaggtatttttgaatttattttagttttgggttaatgtatatttgtttgttgttgttttttagttgggttttgtgaaaatagaatggtaatagtgtgtggttgtataggaggaaggtgtggttgtaatgtgtgtatttgtttttttaatatttatttagggtttttgttggtattttgtgttttatttggtatgtttaggttttagaggtgtttgtggtgtgttggggaaagtttagtgttggtagtgtaggaagttttattgtagagatatggaaatgtgaatagaagtttttttggggtagtgtaggggaatttatgtaagggagtatttgagttgtttttgaaggataagtaggagtttggagagtaaataaatgggaagggaaaattaggagtaaatatgttaggggggttattaaagtatatagaggaaattgaggaaggggatgataggatgttttaggtatttggggaggggagaatggagagtaatagagtagaggtttatttggatgggttattttgatagatatagggttgatttaaggatgggtatgaggaagtttggaggaaggaggtttgttagaagttattgtggtttgattgggagggtgattagttagggaggggaggggtagtgtaggtggtttattagaaaatagtttttagaaagattttataagtttattgaatgttttttggttttatttgttttttaaaagtttatatttttaaaagtttttttatatgtaaatttttggggaaggtttgattttatttttttgaattttttgttagaaagttttttggtgttaggtaattttatgtagtttaagtatttaagggttttgaggatagttaagttttagaatagtggtttaggggtatttagggagtttttaagtagtttgtttattaggtgaagaggggtgtagagatgggtgtggtttggagtaatttatattggggtttaaatttggggtttattttttgttaatttagtgtttgtttagatttgagaattgtatttggtatttttaattttaaggtgtatttttaggttagtaaattagtatgattagtgttgtaaagtaggtttaaggtagttaaattgagtatttttaaaatattttttataagagataaagtattatgttgtaggtaaagtatagaaaaaatatttattttttagggttttaaaatatattgtaaataataaatatatttaaggtagtaaagggttaatttaaaattaaaaatagttttttaaaattaaaagtaaaaatatttggtgttgggtggaaaagttttgggaaagttgtagttttggttttaattgttgtttttttattttatttttagtattagaatttttgagtaattaaattttttttaggagattttttgagtttttgtttttttgtgtttagatataggattttttgagtatgagagggtttttaagtatatggttttttttttgtattttttttggttttttgtatttagttgagatttttttgttttgtggatgtgtgattttggtttttgttttttaaatgaataaaattaaatgttagtggttgttatttatattaaataatattaaaattttatatgttgtatttgagaaaatataggtaagtgagttgaaaatgttgaagttttatttaatggttaaagaggatttaaattgtatttgggttttgtgagttaatgtagggtattagatttttgaaattggtaggttagttattattgttattagttaagggttggttaatttattaggttttagttaaaattttggtgaagtttatagtttttttagtatttagttgtgttgtgttgaagaatataggtttggaaagaagagagaattattatgagtatagtagggtgtttaggttaagagtggtttttaaaattaatgtttggtggtatattaaaggtttttatgataagaatagttgttattaattatgttaagtttaaggttggatatttggtttgttatttttatatttttaataagatttgggttagatgttattatgtttgttagatgtaattatgtttgttagatgatgtttaattttaagatttatataatttgaagggtatagtttggagtgttgagaattttgagatgtttgatgttggttttggtaatatggtttttgaagaattggtatgggtatttgtagtttaggttgatgggtttttttagaagaggtaaggataataaggtattttattattttgttagattttggtaatgtgtgtttgggttgtagtagttggtgtagtgattaaggattaagagatggtattattggggtaagttttaggttattggtgtatgttgggaaaggttatttttttaggtaatatagtgagtgttggttgagtttaggtttagtttttatagggtaaggagtttaataggtttggggagagttggagtttagatgaggtgggagtttaaattagaagttatttgtttagtgttttaagataaaggtagtaattatagtagataatggttttagtttaaggtattgaaatttttagttattttttgtaaaaaaaattttttaagggataattgagaaagatttttttatttagggaaaagaaagggggataagaggttttaggttttttggttttttttttttggtataggtttttagttaggaagtatagtagtatttaggaatgttgtttttttttattttagagatttttttttatatttatttaaagttttggaaggtataaaagaattttggttggttttttatttgtgagttttttgagagtaggttaaggatttattttttgtttagtattttttttaaggtttagagattagtggagttggagttaaatgtggtttttattgtttaggtagggatgttgtagttttaggaattgtattaagatttttgtaaaattattaatttataaaatgttataattgatatttattagtgtaaattagtaaggggtttttgtagaatttattgtttattttttaaatataggattgtaagttttggagggttgggatttgtgtgtgttttttgttttttttttttttttgaagattttatttaagttttatttaatattttaaattatttgaatttgtggatttttttattagagattaaatatatgtttaagaatatttggtttagagatttttttttttttttttttttttttaagtttgtttgtttataaagttttgagagatttttgtggttttgaaattttgtatttttgggaaagaatgttggggaagtaggaggaaattttgagtaaggggtttattttattttattttttttatagattgtaattaattgagggatgatgtggattaggaattgtattgtgtatttagttattaagttgtaggaaaagtggattatttgtttttttatttttttgtttttaggattaaatgtaattttttgaaaattaggaaaaagttaagtattagggtgttggtgatttatggtattggagagatttaaggtagtttttatagttatatttgatttaattttagaaaggtatttttggggttagtttttagtagttgtattgggattttgtaggggaagttagtattgtattgtaattagattatttgggaaagttatttttagggttggggtttgtagtttgggtaattgaggagttaaatgtttttgagtgttgtgtttttaggtttttttggattttttttgggtttttttaagttgaggtagggggtgggttgggggtggagtaggagaataggaggttggtagtgaggtataagtttttttttggtaatagtgagtttgaagatatgtagttaagggtaagtgttgtagttgtttttgttgggatgggtggggttgtgattttttagtgtttagaggagagaagtttttttggttttttaattaagtagtggtgatgaggttagaaattagagtttatttagagtttaatatataggtttttttttttttttttttttattttttgggattatttattttttttaaaagtaatttttgtttttatttttaggatttaaggtttgtttgttaagtagtgaattttaataggtttttttaaagtgatagagtttttaggtgtgtttattaaaagaatatggttttgtgtgtattttatgtgtttttttttttagttttttgttagtaagattaatttttttaattgttttggatgtaaatttgtgtattggtaagagttttgattggttttgatggtattttggatttgggattgggtgagtttggttttaggagtttttagaaagttttttagtttaatgtagagataggagtttagttggtttttttaagtaggtttgggaagggggtttattttgagtttaagtttgggaaatttaagggtttagttgtttgatggaagttagttaatgggggaggggtaggatttttggttaagttttttttgtagtgtagtttgaggattaagtgtggggatagggggtatataggtattgtgaggtgaggggaaaataaaataaaataaaatattttggtgatgtgtgtaaggagtagatttgtttggagtttaggtttttgttttggttatttggttgttaatggggtaattttgagggttatgttattttttttaggttaggaggagtttgggatgaattttatgtttttgtgttttttttaggttagttgtatttataatttaaagattgaggttttttattttaattttttttttagttttttggggagggggtagtattattttttagagtggtgtattgtgatatttttgtgtttattttattaattagttaataattgtttaaattagagattttataggaatagaagaatatttagtaataaaaattagaaatatgttttatgatttgtgggggggggggggggttagtgtgtagatatagttttagggattttttattaatgatgaatatttttaattgtttttagtttgtgtttttaatatttaggtagtttgttatgattttaggttgtttagtttttttagtttgatttagttgtgttggttttgtttatattagtgtatagtttaagttagttaggatgttggggttatgtttgtattaatttagttaagggtttgaggtgtgttgggtttgtatagtttgtggttgtaagagtatttagagtgttttttaattttttgtaggaaattttatagttaaggaagtttagtggtttgagttatagggttttgttttgtgtgtttagaggtaatagtttattttggtttgtattggtgttttgtgatagtgtagtgagtttttttttagtgaaagaaaagaaaaaagtttttttttagtgaaatgggatattatggtttttagtggtttagggttttggagattgaattttgttgtagtttttattttggggtaaagtgtttggttagttggtgataaaagagtttgtttgtaggtgtgtttggggagttggggagggggtgtgtgaggtttggagggtttttgggttttttttaggtgaatttgagaagagataggaagatagtggttggatgtgtgtttaggtttgtgttgttgtggattgtggagttgtgtagaagtgtggtttggtgggtggtataagtttgatagttgtgttgtgtagtttgtttgtgtttggttaagagttttgtgagggtgtggggagaggattggttttgtagggagtggaggttgtgtggttgtattggattttatagttttaagttgtggtatgaggtgaattttgtaaagtgtgtttttgttatgtattgtttgatttttagtattgtgtgtagtaggattttggagtttatttgtttgtggaaattgagtttgtagtgggaaggtagtgggtggagggtgggtaggtaggggtttggggtttgtggttttttatttttgtgtttttttgtgttagttttgaatgtttttttggggtgtttttgtttagttgttttggttgattttgttttgtagttagtttgaggttaggtggttgttttttgtaggttataaatttttggtgtaaaagtagggttttgaatgtgatattgtattagagtgtttagttaagtgagttgtttttatttttattgtgttgggtggtgtaaattgtgggtgtaggtagaggagttgtggttttgtgttgggtgggagttgaagtttagagttttgttagggtttttttgttgagtgtatttattgttgttgaggtagagtgtggttagtatgaggattagtatgattatgattttggtgtttatggtgtgggtgggtgggtgggtgggtggatgagtgtgggttgggggttggatgttgagtgggtaatgtggttgatggagagtgaaagtgtggtggtgggaggtgtgtgttgggtgttttagaggggagagttaggtggggtggggtggggtgtgtggtgaggggtgggtttggagttgagtgttggttgtggttggggtttttgatgtgtgatttttttggtggtattttttatttattttttttgttttttttttgttttttttgtgtttttgaggtgtagtgtgttttggtttttgatttttttaggttttgttgggttttgtattgttggtttggtttgtagtgaggtttgtagtttgagtgatgttggttggagggttgtttattgtttttgtgatagggttttattggagagattgaggattttaggtgtaaagtggggtgtgtgtggaaagttgtgggatggggttttttgatggtgggaattgaatgagaattaatgaaaagtaaataagttagttttgggtggagggtttgttggtggtggtggtttaaggtagttgagggggttttgttttttgtgtgtgggggtttaagtttgttatttgtttggtttgtggtgtagttgttggtagagtttgatttgtgggaatgagatttgtttttgtagttagtgtggtttggattttaagtttatggtgttattagttgagttttagtttttttgtttgtataaataaagtagaaggtgttggtggtttttagtaaaagtgaatgtagtttttgtatttttgattttttaatggtgaaatgagttaattataggtttattttgtggagtgggatgggagatttaatgagatttgttttatgttgtgaaattttttgtattgtgtttgataagtagatagtatttaataaatggtagttgtaagtaagttttttaaatttaagtatttattgttttatttaagaaaagttttgtgtgatttaaagagttgagaatttttttattttgatttttgatttttaggatagtattattggtgtttgttttttgggtttagaaaattttttttatggagttgttttttggtggtgtttagttttttggatatttttgagatattttagatggttttagtttggtggtgaagggagggtgtaggttggtatttaggagatgtgggggtgaggagagtgtttttttgggttttgttttgtgattgtaggttgttttagttatttttttgtgttttttttagtatagtgtttagtgaagtggggttagttgttgtgtttatttaggggtttgttttggggatatgtttttgtttttggggagttttggttgttggggagtgggtggttagtggttgtattaggtgggagtggttaataggaggttgtgagggttttggaattttgttggtgggagtaggtgttttttgtgtattttttttttaaaattattttggttgttagatggttgtgggttggtattttatttatttatttatttatttatttatttatttatttatttatttatttattttgggtattgggtttggagttgggaattttattgatttggttttgtttttaaagaattgaaggtagtgaggtttagtgaagaaggtagttgttgggtgtttttaggtttttgttgggttgggttggggagtttggttgtttattggttgtagtgttggggttttggtgttttttggtggtggtgtttttttttttgtttttagagttttggttagttttatttttgtgtagttgatgaaatttgggagggtgaaggggtttgtgggaaatttatatttgggtggaggggtgttttggagtttggagatttgattttgtgggagttgtgtgtagttttgtttgtttttaaatttggttaaagtaaatgttattgttttttgttttttttttttttttttttttttgttataaaattaggtgggtagttggatttaggatttgttttagaagtttgaaaggtttgtgtgggttgagttgagggtgaattagggatttaggtttggttgttgttttttttgtaggtgttttgaggttttagaatagaagttattgtggtatttatggggttattttttttgttagttgtttgttaaatatttattgagtatttattatgtgttagatttgggttatatgtttgaagtagtttagaaaaggtattaaatgtttagaagtatatggtgttaagtataagtaattatgtataaaatatttagaaggttattaaatgttaggggaagatggagtagaggaaagtggggtgggagttaggattttaaatagggtggttaaggatttatattttaggtataagttttataattttataattggtgattgaaatttaaaattttggttgggtatggtggtttatgtttgtaattttagtattttggaaggttgaggtgggtggattatgaggttaggagtttgagattattttggttaatatggtgaaattttgtttttattaaaaatataaaaaaattagttggttgtggtggtgggtgtttgtagttttagttatttgggaggttgaggtaggaaaatggtgtgaatttgggaggtggagtttgtagtgagttgagatggtgttattgtattttagtttgggtgataaagtgagattttgttttaaaaataaataaataaataaatatgtaaataaataaataaatatgtaaatatgtaaataaaataaaataaaattttgtatattttgggggtttttgtattgtttgtataggtaggtggttattagattaggttattttgatatgtttttagtttatttggttataggggtattttttaaatttgggttagtgaagttttttatttttttttttgtgttttttgtttatgtttatgtttaaaaggttttatttttttttttttgtttggggatttttattttttatagagttttatttttttttgaagtttttagattttgtgttgttttattaggtaatgtagggtatagtggttttttagggatgttttgttaagtatagtttaaggtgggaggtaggggtttggttgttgagttaaaggtagggtattttttgagttggtatgtgtgttatggtttttagatttttaggtagtatttgtttatttttttttgtttggtttgggttgtttatttttttagggtttaatggttgggtttgtaagagggtttttagtagggattgaaggtttatattaaatttatgttgtatagtgtgtaattgataaggtgattttaggtggtattttgaaatttataaaatatagatttatgtatttatttttttaaagtaataagaaaaaatataattagtatagtaaaggtagatattttagatattgtttaggttttttttttaatatatggtttaagttttaaaaagtaagttaattgaagttaatatagtaagtgttagtttaggtggttggagatatagtaaaaattttgatagtaatataaatagatttgaaatttgaaaattttttttatatgaagaatattttttgtattatttgatatttttttattgtaattttttttttgaaataagtatttggttttaaagtgttgaaatataaaattatataagggaggtatgatgttttttttatttgtttgttaggtgaggttggagaatgttggtttaggagtgtttaggttataggaagattgtggggttttatgggatttttggatatttttggttttgttatttttttaggagtgttttttttttagtttttgtgtagttttggagggattttttttaattatttatatttgtttttatttttttggtatttggttttggggtttaggagtagatggtttattttaggaattaggaagtttggtgaggaagataaatttttattgttttgttgatgttatttgtgtagtaggtatattagttgatatggtggatttggttagtgtgaaattatttggtttagagaaggtttttaggaagatattgaatagtggatttatataggattttagtttgttttttttgaatttgttaatttggtatttttaaagattgagtttgtagtataagttttattgttttagttttgaagatatggaatttaagtttttatgggttttgagtttaaggtttagagttgagggttttggttaatatgatagagttaggtaggagtaagggtatatttttttggggttaatgtttttggattttggaatattagttaggttttgaaagtatttttggggatataagttatttttatggtagttatttagggagttttttggaattttgtatttagggttaggatttggtatttgattagttggttatgttttttttgtttagatttttattggttttaagagttagttgtaaatagttttaggttgttttagagggaaggatttttgggaggtagagttgatttttattggttttgggtatatgtgtgggtaagtaaggtttattgttagggtatgtgtatgtttagtaggttaggatttttgtttgagtaggttttgtttaaagatttttttgttggatagtgttgaggtagggggatttgagaatgtaagaataataaatttagtttttttttatttttataatataaaatatttttgtgattttagatgtgtgtgtgtgtgtgggggggggggtggggattttttatatataaagttagtagttttttagttgtagatattagttggttgttttttaatttaatttaattttgagatgatttatttggaggtaggtttaggttttatatgttgaggttttagttttataaggttgtttttattttagatattagttgtaagttttgggttgtttttttagtgtttttgattaaatgattataaattagggtttttatgattttatttttgggttttattaatttgttattatagtttatggaatttagggaagtatttatgtttattggtttattaaaaagggtattatgggttgggtgtggtggtttatggttgtaattttagtattttgggaggttgatgtgggtggattatttgaggttaggagtttaagattagtttggttaatatggtgaaattttatttttattaaatatataaaaattaattgggtttggtggtgggtatttgtaattttagttatttgggaggttgaggtaggagaattttttgaatttgggaggtggaggttgtagtgagttaagattatattattgtattttagtttaggtgataagagtaaaattttgttttaaaaaaaaaaaaaaaaggatattatgaaggttataggggaagagatgtatagggtgaggtatgggggaaggggatatgaagtttttatgttttttttaggtattattttttaggaatttttattgttgtgaagttttttgaattttgttttgttgtgtttgtatagaagtttattatataggtatgattgattatattattggttattggtaatttagtttttagttttgtttttttttttagaggttgatggggtggggttataagtttttgttttttaattttgtttggtttttttgatgattagtttttattttgaagttatttaagggttgttagttattagttaagtaaattaaagattttaggagttgtatgttaggaagttgggataaagattaaatatatattttataatagtatagttggtattttttgggatattttttgggattgttggattattagggtttatagggtaaattagatttaaggttttaggggtttagatttgtgtttttagtttttatattagtttttaggaattaagtagtgaattttttttgtgtttagttattatagttaggtttggattttttttgttttttttttttagttttattttttttttttattttttttgtttttgggtagattggatttagtagttggggatttattgaaggtttttatattggagtatatattagtttttatttattagaaattttagagtgtgtatattgagagtgtgaatagtattgatattggagttattttgtgttgtgtgttttttgttatttttttttttgtatttagttgatgaggtgggtttaatggtaaggttattttttgaaataagggatagagattataaaattattatttgttagggatggagtttaaatttattttgaagtagggttgtttttggtgaaggagaaagagttggtttgttatataaaatatagtatgtttagttatgtttgaattttataaaaaagtaagggattttgtgtatttgttttttgtttgtttgtttttttttgtttttaagtattagtgtgttttaaatattgtatggggtatggggtatatttattaaaaagaattattagtgtttgtttgaaatttaggtttaatggagtattttgtatttttatttgtagagtttatgtttgttatattgttatagttttttgttttgtggttttttgtttgaatttttagaatatgtggttgaggttgggaagggaagttatggagttattttttttttttattgagaggattttttgagttttattaatatagagatgttagaaagtggtgtatgaaagtaatataggaatgatttttttttgtttttttttttgggttgagtagtgtaatatagtatttgttttaattttatttttttagaaatagttttggttatgtttgaagtaagggtaggtaggttttttatttttaatattattagttttgttttttttttggttttggtagatgtgtatgatgtttagttattgatattttttttatttattttaggtgggtgagttgtgggtggagaaggaggggagaaatattttagggaagagggttatgtgagtaatattttgggttggtgggattttgtaggagaggaaagagtttaagagttgttgtgggttgtaaaggaggagttgggtttgttgtttgtatagatggttttttttaattagaaaagttaggattttagttttattggttttttttgtttggaagaggagtttttatttttttttttattttatatttttgtggtggggtgtttgtagttttattgtatggatgatttgaattgggttgtatatagaggttattgagagaggtttttaaggttgagtgtaaatgtgggttttattagtagtttggtttaggggatgtaagtgggagatggatttaggtggggatatttttgaggtatttatttatttatttatttatttatttatatattaatttatttatttatttatttattgaaatatttagttatttatttatatgtttatttaatatatgtatttatttgtttatttatttatttatttatttatttatttatttatatattaatttatttattatttatttattgaaatat

SEQ ID NO: 70 - DNA, 20506 bp, Artificial Sequence
  chemically treated genomic DNA (Homo sapiens)
gtgttttggtgggtgaatgatgaatggattaatgtatgggtaggtgggtggatgaatggatgaatggatggatggatgggtatatgtgttggatggatgtatggatggatgattgggtgttttagtgggtgaatagatgaatggattaatatatgggtaggtgagtagatgaatggatggatattttagaggtatttttatttgagtttattttttatttatattttttaggttaggttgttggtgaagtttgtatttgtatttagttttgaaagttttttttagtagtttttgtgtatagtttagtttagattatttatgtagtaagattatagatattttgttatagggatgtagggtggagaaagaagtaaaaattttttttttaaataaggagggttagtggagttggaattttggtttttttaattggaagggattatttgtgtaggtagtagatttagttttttttttataatttatagtagtttttgagttttttttttttttgtagaattttattagtttaggatattgtttatgtggtttttttttttgagatattttttttttttttttttatttatagtttatttatttgaaatagatggaaagagtgttagtagttgggtattatatatatttgttgggattagaggaagagtagggttggtgatattggggataagagatttgtttatttttgttttaggtatggttaggattatttttggaagggtagggttggggtaggtgttgtgttatattgtttaatttagaaagaagaataagaaaagattatttttatattgtttttatgtattattttttagtatttttgtgttaataaaatttaagaaatttttttaatgaaaaaaaaaagtgattttataatttttttttttaattttaattatatgttttgaaggtttaggtagaagattataaggtggggggttgtggtaatgtgataagtatagattttgtaaatgaaaatataggatgttttgttaaatttgaattttaaataaatattgataattttttttaataagtatgttttatgttttatgtaatgtttgggatatattgatatttaaaaataaaaagaaataaataaataaaaaataaatatataaaattttttgtttttttgtgaaatttaaatataattgggtatgttgtgttttatgtggtaaattagtttttttttttttattaggaatagttttattttagagtggatttaaattttatttttgataaataatagttttgtgatttttgttttttattttagggaatggttttgttattgaatttattttattagttagatgtaaggagaaaggtgatagaaggtatgtagtatagggtgattttagtgttaatgttgtttatatttttagtgtgtatattttggggtttttgataggtaggaattgatgtatattttagtatgagaatttttagtggatttttagttgttgagtttagtttgtttagaggtaaggggaataggagagaggggtggggttaggaaagggaggtagaaggaatttaggtttgattgtggtgattgagtataggaagggtttattatttggtttttgggaattggtgtggggattgggagtatagatttgaatttttggggttttgggtttgatttgttttatgagttttggtagtttgatagttttggggaatgttttaggaaatattaattgtgttattgtgaaatatatatttggtttttgttttagttttttggtatgtagtttttaaaatttttggtttatttgattgatggttggtaatttttgggtagttttaggatggaggttagttattagaaagattaagtaggattagaaggtgggaatttatagttttattttattagtttttgaggaaggaaatagggttgaaggttaagttattaatgattagtaatgtaattaattatgtttatgtaatgagtttttatataaatataataaagtagggtttagagggttttatgatagtggaggtttttggaggatggtgtttggagagggtatggaggttttatgttttttttttttatattttgttttatgtatttttttttttgtagtttttataatatttttttttttttttttttgagatagagttttgtttttgttatttagattgaagtgtagtggtgtgattttggtttattgtaatttttgttttttgggtttaagagatttttttgttttagttttttaagtagttaggattataggtgtttgttattaagtttagttgatttttgtatatttagtagagatggggttttattatgttggttaggttggttttgaatttttgattttaggtgatttatttatattagttttttaaagtgttgggattatagttgtgagttattatgtttagtttataatattttttttaataaattagtaaatataagtgtttttttgagttttatgagttgtggtagtaaattaatgaaatttaaggatggggttatagaaattttaatttatggttatttggttagaagtattgggaaaataatttagggtttgtaattggtatttgaagtaggggtagttttgtgggattggggttttaatatgtggggtttgagtttatttttaggtagattattttagagttgaattgaattagaagatagttagttggtgtttgtagttgaaggattattggttttgtatgtggggaatttttgtttttttttttatatatatatatatatttgaagttataaaagtattttgtgttgtgagagtaaggagaaattgagtttgttatttttatatttttagatttttttgttttagtattgtttagtaaggaagtttttgggtagagtttgtttagatagaagttttggtttgttagatgtgtatatattttgatggtaagttttgtttgtttatatatgtgtttagaattagtggggattagttttgttttttaggggtttttttttttagggtagtttggggttgtttgtaattggtttttgaggttagtggggatttagataggaaaaatatggttagttggttaaatgttaagttttggttttgggtatgggattttaaaaggttttttggatgattgttatgggagtgatttatgtttttaagagtgtttttaggatttggttgatgttttaggatttagagatgttggttttagagagatgtatttttgtttttgtttggttttgttatgttggttgaggtttttaattttgagttttgggtttagagtttatggagatttgggttttatgtttttaaagttgagatagtggggtttatattgtaagtttggtttttgaaagtattaaattgataaatttaaagaaggtaaattaaagttttatgtaagtttattgtttagtatttttttaagggttttttttgggttaagtggttttatattgattaaatttattatgttagttaatgtatttgttgtatagatgatattagtaaggtggtgaggatttgttttttttattgggttttttggtttttggaataggttatttgtttttgaattttagggttaggtgttaaaggagtgagggtagatgtgggtggttgggaggggtttttttaggattgtatgggagttgggagaggagtatttttggaggggtggtagggttaagggtatttagggattttatagggttttatagtttttttatgatttgagtgtttttggattagtgttttttagttttatttggtaggtaagtgaggaagatattgtgttttttttgtgtgattttatgttttagtattttggagttaaatatttattttaagagggggattgtggtgggagggtgttaagtaatataaaaaatattttttatgtagaaaaggtttttaaattttagatttatttgtattgttgttaaaatttttgttatgtttttagttatttagattagtatttgttatgttagttttaattgatttattttttaaaatttgaattatatattaaaaaaaaaatttgagtaatatttgaaatatttgtttttattgtgttagttatatttttttttattattttaaaaaaataaatatataaatttatattttatagattttagagtattatttgaagttattttgttaattatatattgtataatatggatttagtgtaaatttttaatttttattgggaatttttttgtaggtttagttgttgggttttggaggagtgaatggtttaggttaggtagaggggggtaggtagatgttgtttaggggtttagagattatagtatatatgttagtttaggagatgttttgtttttaatttagtagttagatttttgttttttattttgaattgtgtttaataaggtatttttgaggagttgttgtgttttgtattatttggtagagtggtatagagtttgaagattttaggagaaggtggggttttatggggagtaagagtttttaggtagagaaagaaaggtggagttttttgagtataagtataagtaaaggatatagggaaaggggtggggaattttgttgatttgaatttgagaggtatttttgtggttgagtgagttggagatatgttaaaatggtttggtttgatggttgtttgtttgtgtaggtggtgtggaggtttttagagtgtatagggttttattttattttatttatatatttatatatttatttatttatttatatatttgtttatttatttatttttgagatggagttttgttttgttatttaggttggagtgtagtggtgttattttggtttattgtaagttttgttttttgggtttatgttatttttttgttttagttttttgagtagttgggattataggtgtttgttattatggttggttaatttttttgtatttttagtagagatggggttttattgtgttagttaggatggttttgaatttttgattttgtgatttgtttgttttggttttttaaagtgttgggattataggtatgagttattgtgtttggttagggttttaaattttaattgttaattgtaaaattgtgaggtttgtatttaaaatatggatttttggttattttatttaaaattttaatttttattttatttttttttgttttatttttttttagtatttaatggttttttaagtattttatgtgtaattatttatgtttagtgttatgtgtttttaaatgtttagtgttttttttaaattattttaaatatgtagtttaggtttagtatatagtgggtgtttagtaagtatttaatgaatgattagtggaagggatggttttatgggtgttatagtagtttttgttttggggttttagggtgtttgtgggaggggtagtggttaggtttgaatttttggtttgtttttgatttagtttatgtgggttttttaggtttttgggatagattttaggtttagttgtttatttgattttgtggtaaagaaaaaaagaagaagaagaagtgagaggtgatggtgtttgttttggttagatttaagggtaagtgaggttgtgtgtggtttttgtagggttggatttttgagttttagggtgtttttttatttgggtgtagattttttgtggatttttttgtttttttgggttttattagttgtgtaggaatggagttggttagagttttgggagtggggagggaggtgttgttattagagggtgttggagttttagtgttgtggttggtgagtggttaggttttttggtttagtttagtaaaggtttggggatgtttgatggttgttttttttattggattttattgtttttagttttttaagagtagggttaagttagtggggtttttggttttaagtttagtgtttagggtgggtgggtgggtgggtgggtgggtggatggatggatggatggatggatggagtgttggtttatagttatttaatggttaaagtggttttggaaaaaaaatgtatagaagatatttatttttattagtggagttttggagtttttgtagttttttgttgattgtttttgtttaatgtagttgttgattgtttattttttgatggttaggattttttagggatagggatgtgtttttagggtaggtttttggatggatgtggtgattgattttattttgttggatgttgtgttgggaaggatatagagaggtggttggggtagtttgtggttataaagtgaggtttaaaggggtgttttttttatttttatgttttttgggtgttgatttgtattttttttttgttattggattggggttatttgggatgttttgggggtatttggagggttaagtattgttgagggatggttttgtgggaagagttttttggatttagaaggtagatgttagtagtattgttttaggagttggaggttggggtgggggagtttttagttttttgggttgtatggagttttttttgggtaaggtagtaagtatttaggtttaaaggatttatttatagttattatttattgagtattgtttgtttgttagatatgatgtagagaattttgtggtgtggggtgggttttattgaattttttgttttattttgtggggtgggtttgtgattagtttattttattattgagaggttggaagtataaaggttatatttgtttttattgagagttgttggtgttttttgttttgtttgtataggtgaggaaattgaggtttggttggtggtgttgtgggtttggagtttgagttatgttgattgtaaagatgggttttatttttgtagattgagttttgttggtggttgtgttgtaagttgggtaggtggtgagtttgagtttttatgtatagaaagtaggatttttttggttgttttgggttgttattgttagtaggttttttgtttgggattaatttgtttgttttttattggtttttatttagtttttgttattgaaaggttttgttttgtagttttttatgtgtgttttattttatgtttaaggtttttagtttttttagtggggttttgttatagggataataagtggttttttagttggtgttgtttaggttgtggattttattgtagattgggttagtggtgtggggtttagtggagtttgagaaggttaaaggttggagtgtattgtgttttgggagtatagagggagtggaggaggggtgaaggggatgggtggggggtgttgttgagggagttgtgtgttagagattttggttatggttagtatttggttttgggtttgttttttattgtgtgttttgttttgttttgtttggtttttttttttaaagtgtttggtgtgtgttttttattgttgtatttttattttttgttagttgtattgtttgtttggtgtttggtttttgatttgtgtttgtttgtttgtttgtttgtttgtttgtgttatgaatgttaaggttgtggttgtgttggtttttgtgttgattgtgttttgttttagtgatggtaagtgtgtttggtggggaggttttggtgaggttttgggttttggtttttgtttggtgtagagttgtggtttttttgtttgtgtttgtagtttgtgttgtttgatatagtgggggtggaggtagtttgtttagttgggtgttttggtgtggtgttgtgtttaaagttttatttttgtgttgagggtttgtgatttgtagagagtgattgtttgattttaagttggttgtagagtgaggttagttgggataattgggtaggaatgttttaagagagtgtttgggattggtgtgggaaggtgtgagggtggggagttgtggattttagatttttgtttgtttattttttatttattgtttttttgttgtgggtttggtttttataggtgaatgggttttgaggttttgttgtgtatagtgttggaggttgggtggtgtatggtgagagtgtgttttgtaaagtttgttttatgttgtgatttgaggttgtgaggtttgatgtagttgtgtagtttttgttttttgtgaagttgattttttttttatatttttgtggggtttttggttaggtgtgggtgggttgtgtggtgtagttgttgggtttgtgttatttgttaggttgtgtttttgtatagttttgtggtttgtagtgatgtggatttgggtgtgtgtttagttgttgtttttttgtttttttttgggtttatttgagagaggtttagggattttttgagttttatatgttttttttttagttttttaaatatatttgtagataggtttttttgttattagttggttaagtgttttgttttagaatgagagttgtagtaaagtttaatttttaaggttttgggttattgggaattgtggtgttttgttttattgggagagggtttttttttttttttttgttgaagagaaatttgttgtgttgttataggatattgatgtaaattaaaataaattgttgtttttgaatatataaaataaaattttgtggtttaggttgttgagtttttttggttgtgaagttttttgtaaagagttgaaggatattttgagtgtttttgtagttgtgggttgtgtaggtttagtgtgttttgagtttttggttgggttggtgtagatgtggttttggtgttttagttggtttggattgtgtgttggtgtgagtaggattagtgtagttgagttgggttggagaagttgggtagtttggggttgtggtggattgtttaagtgttaaggatatagattgaaggtaattgggaatgtttgttgttgatgaaaagtttttgaggttgtgtttgtatattgatttttttttttttttgtaagttatggggtatgtttttagtttttattgttggatatttttttgtttttgtaaggtttttggtttgggtagttattgattgattggtgggatgagtgtggaggtgttatagtgtgttgttttgggaaatggtgttgttttttttttggagggttggagagaggattggaatgaggaattttggtttttgagttatgggtgtaattgatttgggggaagtatagagatgtggggtttattttagattttttttggtttgggaagggtgatatggtttttagagttgttttattggtagttaagtaattagggtaggagtttgggttttaggtagatttgttttttatatatattgttagaatgttttgttttgttttgttttttttttattttatagtgtttatgtgttttttatttttatatttagtttttaagttgtattatagagagagtttggttaggggttttgttttttttttattggttgatttttgttaggtagttgggtttttgggttttttgggtttaaatttagggtgggttttttttttaagtttgtttggaggggttagttgggtttttgtttttgtattagattggagggttttttgaaaatttttggagttaagtttatttggttttaaatttggggtattattagagttagttaggatttttgttggtatatggatttatatttagaatggttgggaaagttagttttattgataaaaagttggaggaaggagtatatgaggtatatatgagattatgtttttttggtaagtatatttgggggttttgttattttaaaaagatttgttgaaatttgttgtttgataggtgggttttaggttttgggagtagaagtaagaattgtttttgaaggaaatggataattttagggggtggagggggagaggagagagagtttgtgtgttgagttttgaataggttttgatttttggttttattattattgtttggttggggggttagaggagttttttttttttgggtgttggagagttatagttttatttattttagtgggggtggttgtagtatttgtttttggttgtatatttttaagtttattgttgttgggagggggtttgtgttttattattggttttttatttttttgttttatttttaatttattttttgttttagtttggaagggtttaaaagaaatttagggaaatttggaggtataatatttaggagtgtttagttttttagttatttaggttgtaggttttggttttgggggtggtttttttaggtgatttggttatagtgtagtgttgattttttttgtagggttttagtgtagttgttggaagttggttttagaggtgtttttttggagttagattaggtgtaattgtgaaggttgttttaggtttttttagtgttatgagttattagtattttgatgtttggtttttttttggtttttagggagttgtatttggttttggggataaggaagtggggggataagtggtttattttttttgtaatttggtggttgaatatataatgtaatttttagtttatattattttttaattgattgtagtttgtagaaaaaataaaataaaatgagttttttatttaagatttttttttatttttttagtatttttttttaaaggtgtagaattttagaattatagaggttttttagaattttgtaaataggtaaatttaaaaaaaaagaaaaaagaaaaaaaatttttggattaaatatttttagatatatatttaatttttgatgaaaggatttataagtttaaataatttggggtattaagtggggtttggataaaatttttaaggaaaaaagaaaaataaaaagtatatataaattttagttttttagggtttgtaattttatatttaaagggtgagtagtgggttttgtaggagttttttgttaatttatattaatgagtgttaattatggtattttgtaaattggtgattttgtaaagattttaatataatttttgaggttatagtatttttgtttaggtaatgaaaattatatttaattttagttttattaatttttaagttttggggaaagtgttgggtagaaggtgggtttttggtttgtttttaggggatttataggtaggaagttagttaggatttttttgtgttttttagagttttaggtgaatgtgaggaggggtttttggggtgggggagggtagtatttttgagtattattgtgttttttggttagaggtttgtgttagaggagagaggttagggagtttggagttttttgttttttttttttttttttgagtagggagattttttttagttgttttttgaggaattttttttataaagagtaattggaaattttagtattttggattgaaattgttatttattataattattatttttattttgagatattgagtaggtggtttttaatttaaatttttgttttatttaggttttggttttttttaggtttgttgggttttttgttttgtagaagttgagtttgagtttagttagtatttattgtgttgtttgaggagatggttttttttaatatatattagtaatttggaatttattttagtgatgttgttttttgatttttaattgttgtattaattgttgtagtttagatatatattattaaaatttggtagggtagtaaagtgttttgttgtttttattttttttagggaagtttgttagtttgagttatagatgtttatgttgattttttgaaagttatgttgttagagttaatgttaagtattttaaaatttttaatattttaaattgtgttttttagattgtgtaagttttgaaattgaatattatttaatgaatatagttgtatttaatgaatatagtaatatttaatttgagttttattaaaggtgtagaggtgataagttaagtgtttaattttgaatttggtataattagtggtagttatttttattatgaggatttttagtatgttattaggtattaattttaaaagttgtttttggtttgggtattttgttgtgtttgtagtagtttttttttttttttaaatttgtgttttttagtatagtatagttggatgttggagaaattatgggttttattaaggttttggttgaagtttagtaaattagttagtttttagttaataatagtgataattggtttgttagttttggggatttgatgttttatattaatttataagatttaaatgtagtttaagttttttttaattattgggtgaaattttaatatttttagtttatttgtttgtatttttttaagtataatatatgaggttttggtgttatttggtgtggatggtagttattaatatttgattttatttatttgggaaataaagattaaaattatatatttataagataggaagattttagttgggtatagaagattgggagaaatgtgggaagaaagttatgtgtttgaaagtttttttatgtttaagaggttttgtgtttgaatatggggaagtgagggtttagggagttttttggagaggatttgattgtttagaagttttagtgttaaaaatggggtggggagatagtagttggaattaaagttataatttttttaagatttttttatttaatattaaatgtttttatttttgattttagaaaattgtttttagttttgagttaattttttattgttttgaatgtgtttgttatttatagtatgttttagggttttagaaaatgaatgttttttttgtattttgtttataatatgatattttattttttgtgaagagtattttaaagatgtttaatttagttattttggatttgttttatagtattgattatgttggtttattggtttggaaatgtattttgaagttgaagatgttaaatataatttttaggtttgagtagatattaaattaataaagaataggttttagatttggattttaatgtgggttgttttgagttatatttatttttgtatttttttttatttaatggataggttgtttgaagattttttgggtgtttttgaattattgttttggggtttagttgtttttaagatttttaagtatttgggttgtatgagattatttggtattaaagggttttttggtaagagatttagagagatgaaattaggttttttttaggagtttgtatgtagggaagtttttaagagtgtgaatttttaaaaaataaatgagattaagaaatatttagtgaatttgtaaaatttttttagaaattattttttggtaagttatttgtattgttttttttttttttggttggttatttttttggttagattgtggtgatttttggtaggttttttttttttaggtttttttatgtttatttttaagttggttttatatttattaagatgatttatttaaataaatttttgttttgttgttttttatttttttttttttaggtatttagagtattttgttgtttttttttttagttttttttgtatgttttgatgatttttttggtgtatttgtttttgattttttttttttgtttatttattttttaagtttttatttattttttaaaggtagtttaaatgtttttttatatgaatttttttgtattgttttggaaagatttttgtttatatttttatgtttttgtaatggaattttttgtattgttagtgttgagttttttttagtatattgtgagtatttttggagtttgagtgtattaagtggagtatggggtgttagtgagggttttagatgggtgttgggggagtggatgtatatgttgtagttgtgttttttttttgtgtagttgtatattgttgttattttgtttttatagagtttggttgaagaataataatagataagtgtgtattgatttgaagttaaagtggatttaggagtatttggagaaagttttaaataagtaagtataatagttaaaaaggattttttgttagatttatttgaggaaaattaaaattttgtgagagatgaaagggtaaagatgtgggggagggggttttaattatgaggattaggtgtgtgtgtggggtgggtatattgatttgggattgggtttgaggtttgttagtatttagattttgtatttatagtatatggtatgatattgtagtttatatttatttatgttttgtatttgtgtatgttggaatttttattattggggtttttttaagaaagaaattgtattattaatagtatttttaagtagttagtttttttatgattattataattattattatttttatttttattttttaaattaatgagtattttaagatttgaatttggtttgtttggagtattttttttgtttttttggggagtttgggtatagttaggtggtggtttaatagggagttggaaaaagtgttttttttttagatattgaggtttttgtagtagtgttttttttaagaggaaggtttttgtggtatttagatattgattggggttgggtgttgttattgtttttatttttttttttaattttagtgattggttttgtgggttttatgtagaagttattattattgggattgtgtttagagattttttttttagttatttttattttttttttgattttgagagtatgtttaattttgtttttgttttttatttttgtagtttgattagtgttgtattagttgggaagagggtgattgttggggtttgtgttttgtatttttttttttttagggtttgttttatagtttgggttttttgtgagatttgtttttggttttttttagaatggagttggtttttttttggggatgtgtaatggtttttttgtttatttgtaaaagataagtttttatagaattaaatgtaattttaaatttgagagtttgttttgagtgattgggttttgtgattgtttttgaagtttatgtatgttatggaggtattaataaattttgaggtttttgaaattagaagtgaaaaaattagtgaataaattattattttgttattatttttttttgaagttatagtagggttttaggttttaattagaattgttggtaaggtgatatttttatgtataaatgtgatttatagaaggttttggtggtatttgtaattttttgtaaggtatttttttatatatatttttgtgtatatttttttttatgtttttttagaaaataaatgtattttaaaatatatttatagttgaataatttatatatttgaagtggagttatatgaatgttagtagtttatatttttttattattttaaattattggtaatttgtaaagaaatatatatgatatataaatgtgattgtagttttttaatgttagttatagtgtatttttttatttgtattaaaattgtattaaatgtgatattatatgtattagtaataaaatgttaattgttttatggtataaatgttttattgtatgtgggaatttatttatttgaaataaaatttattagttgttagtgatggagtttatagatgtttttggtttatatagttaagtttgtttgtagttaggtgtttgagatttttttttatagtttatgtgtgatagtgtatgggttttttttatgagtagattagatttgtagtttaagtttttggattttttttttttttttttaatttgattgaaatagtagtgttggttttttgaagaataatatttgatttattaatttgttttttttttttttttttttttggtttttttaatttttttatgtaatttttagagatttaattttagtaatattaattttttatatttttttatgtaaaaattttatgattttaggttatggttaatatgaagtttttatagggataggtggttttattttataaattattaaatattatttagtttgaattattttaatgtgatagttatgagttagttgttttaataaaattttgttaattagtttttttttttgttttttagaataattgtatttatttttaggagtgtttataggtgtttagaaaggggaaggtgggattattgttttttttttttttttttgaatggtagtttgaatttggggtttgtagtttttaaaatgttatttaatttgaaatgtagatattttttagagaaagttaagagtttagttttgtattgagaagaagaaaaagttttatgagaatagggtagggtggggtgataaggattatgatggttagtttggttttgggtgtattttgagatgtggattttttgtttttagtgggaattaggtttaggttggtagattggtagttgttgtaatttatttataaaggtgttttaggagtttattgaatatttgtttgaatggaaggaaatgtttaatttattttaatgaattattgataaatagtgttttgattaggggtttttaggtttgagattgaaggtatagtttaattagtatatgggttagtgttaaattttatgtagattgagatgaatttttgtttatttttatattattaatggttttattaattttatttaagggggtgtagagaagaaaaagtggggaaaaaagaaaagataggaaaaaagaagtgatagaagaagagaaaggttgtttagaaaaggaaaaattagttatttgttattttgagatggattatagtttatttgtttttggtgttttgtaaatttgtttgatttttttttaggatagatttttatgtagattgggtaggggtttagatttttgtgggggagtagtgttttgttgttttgttagttatattggtttttgtatttatgtgttttttaaggtttttgttggtttgttaagttatgaagaaagtagttgtgtagagattggggtgggggtttgtgatgtggagtttgtgtgtttaggattttgtttagaatagtttgggagttttaggaatgtttaggttgttgagttttttagtttgttttttatttttttttttagaaggtttgtgtttattggggagtttattagttttatatatttgtagtttgtatttttgtggagattaggttgtggttatttggttagtgtgtagggtaatttgttagtagaggtggttttgttaggaagggggtgtgttatttttttgtggtttttaggaaaggtgaaaattgattgatttttaggaatgggttttggttttttttaaatatttattgtttttttttttagtattttgttatttgggaaggggtttttttagttttttttttttgggttgtgggagtggttttatttttaagtttgggtgggtttttgtaaattgtgtggggtgagtttgagggaatgttgtatttttagagagtagatgtggaaatattttttagggagtttttttttgggtaattttttttagagtttttaaatgggttttttatgtggaggatagatgtgttatggaattttgtaagggttttgaatttttggggattttagtttgtttttttttgttttttgtgtgatggtgtgtgttttagttgtagggtatagttgtttttgtttttatttatgggaaatattttatttgtttaaagtaaatattatttaagttttaggaatttttttgtattttttttttttgtttatgtagatgtatgtgtgagattttttggtaagtttttttaatttggattgggaggatggaagagtaaggattttattttagtagtgtttggaaaaaggatgtgttgaattttttagtttttttttattttatataaatatttgtttattttgtatttggattttgggttataattttaataaatgtagaaagagaaagtggttggaggatggagtatatggaatttaggagaaaatttataaagatttttgtatgttagatatattttgttttggagtgtggtgtttttttgagttttaatgagttttttgtgattatagttatgttttttttttgttggggaggtgttttaggatgttttagttaaagatttttgttttttgttgttattttttttatttggataatttttttggtttatgttttttttgttagtattgggggttataggtttgagttttgggtataggggtgttttagttttttgttttttttattttttaaggtatagagttgttgggtgggttgtttggggttgttattttttttgtggaagttagtagttattttagtttatgggatttttgataaaagtgttttgagagggtaaatttgtgtttttatatttgtttgtattttttggattttatatgtagtagggttttgtgtttggggaggggtggttagtttgttttggttagtatgaaaagttgttggttttttagggatagagggtttagttaaggttgtttgaggatataaattgtttgttattttatttttggggagtagggtttgtagggattgagagtgggttttattttgagaatgtatgtaaggtttgttttgttttgatgttttgatgtgattgtatgtgttttgggggtttattgtggtttataagtggtttgtgaagtttttgggagtaggtggtatatttagtgttgaagatagggttgttgtggaagagtgaagagtttgattgggatttttggtgggttgaaattaggaagtgtttatattagttagagttaaatgaggggtgtgttatggttattgttttgtttagtatgtgttttttttgggaggttttggttatttgtgtatttatttttgtgttatttttagtagttttatttggggttatttatggtggtatggtttttggttgagaggttttgagggtgaagggttattggaagttatgaaagtgttttttgggatagttgaggttaggatgtagggtagtagtattttgagttttagttttatgttggtgttgggtaagtagtgtgttttgtttttgttgtatgattattttgatgggtttttttgtgtttttgtgtgtttgttatgtttagtgtttgttatgtgtttgttttttgttttttgttatttatgggtttttttgttttagtttggttgtgttttgtattttttttttgtttgttgttgtagggtttttgaagggagatgtatggttaaggtggtaatttggaagtagggattggttttagggtttttgtgtaggttgttgtttttttggagttggttgggtgtggggggaatttgttttaatggtgtttttttttgtttttgttaataggaggtttaagatgtgagagggttagatgtttgaggaatttttatagtaggagtttagttttgaaattagtgttagggaagggtttgttatagttttttttgttagggtagggttttaggtattgttaagggttttgttttgtatattttgttatatttttattatttgattatgtagtaaaatatatgatatttattttttatttagtttgattatttagtgttattggtgatatgtagtagtttagattaaggttattattgtatttgttttattagagtgtttttttatggagttatttttttgatttagggtttttgggttttgtattttttgagttgtgtaggtggggagattgggttgagggagtttggttttatggttagttttagggtggagagttattaagagggatgtttgggggtgttaggattagttaatttgggtaaagtttagtgaaggtttttttttgtgggatgggatggtggagggttatatgggaggtttatttttttttttatttatatgggagttgggtttgttttttttgggagggtagtagggttattttgagttgaggtagtagtgtgaggttagggtagagtgagatttagtttttattttgagtatttttatattttttatgttttgtttattattttttgttttatttattattatgtgtgtttatgattgtttttatggttttgtaaaaggatttttaggattaaagtttttatgtaaattgtgtattaagtaggaaatgaaaatgttttgtgttatttgaaaatattgtgtatatttgtgttttgtttggaatattgtttattgtttaattttatgtttttgtttaaagttagtgtttttttttgtgattaatgttttgatgtatgtattgttttttttgtgtagttgttgagtgaggagatgttttttgggttttttgagtgtagttttgattagagttgtggttttttggggtgaattattttggtttttttattgattataaaaatatggtgggtttatgggtagagtttaagggaatttggtgtgtattagggttgattttagaggattgttgttttattagtgtttttttatatgttagtatttttaaattagggttaagtttagtattgtttgaggaaaataagtatttataatttgtttttggtttttaaaatttagtttataaaataattaattttggatatgaagatttttttttaatttatatttaattttattttttttattatttggtaatgttattattttttgttttttttttgggttttttttgttttgtgtgttatttgtgttttgggttttttttataggatatttttttaagagaat

SEQ ID NO: 71 - DNA, 30068 bp, Artificial Sequence
  chemically treated genomic DNA (Homo sapiens)
ttgaatagaatgggtttgtgaggttggaaggaggtattttttttggtttaagaattatttgttttgtgtgggaagagattgatgggtggaagttttagtgggggagtaggtgggagtgattgatgagaaggagaaaaattggttgtgggggatagaaattggtatgttagttgtttgtttagttattttattagtataagtatagatgtgagagatagaagttggaaagttagttgtttgtttagttattttgttagtataggtattgtttagagtaatgggatttgatgatttttgatggtttttgtagtgaatgattttagttttttttgggagtaaagtggttttgagtagagtttttattaaggaggtattaaagatggaggatttttgtgtagtgaggaaattttttttagtttatatgattgtatggtggggtagaatatgaaaggtatatttagagttagtataaatattgatgtatagtttttttgtattagtgagggtttgagttaaggtaattaatttggtttgttgagaggtagtggagggggtagagtggtagttttaatgatagatgtggaagatattatagtatagtttgtttttgttggtgagtggtgattaggtttggtggaattgttattaataaattaaatgtgattagggtgaggaataggaaagaaggaaatgtggggaaatggggtgaatgttaggtggattagagagatatagttatgggggttaggtgtggtatttggaataatgtgggaggttggattgaagtatgggttagtaataatggtgattgtgggagatttaataaagagtgagtgtagttgaaggagttgggaagtagaaagtatatgtgttaggtgtgaggaagaaaatagatttttggaagttatgagaattgtagagagtgagttgagtatagtttgtgattttgagggtttttaaaattattaaagtagtggtagttgttgtttatagatatgagggttaggttaaaatagtaaggttaagttgtttggatagaaaggttatagggtgtggttttggtttttgtgtaagagttttgattatgttaattatgtttaggaaggaaaggagttgttgttttgtagaaggtgttggggtttgagagattagttagatatgattggtatggagagtatgtgtgtttttatgagaattatgttgagataggtaatagaggaggaagaaatttgggtttgattgaagtaatgggggttgtttgtgaagttttgtggtagtatagtttaggtaatttgttgagtttgattggtgttagggttagtttaagtgaaagtgaagagaggttgggatgaagggtgtaaaggaatagtaaagaaagtatgtttgagatttagaatagaataatgggttgtagaggtaggtattgaggataggagagtatatgggtttggtattatggggtggataggtaaaataatttggttgataaggtgtagattttgaattaatgtgtaagttttgtttggttttaggataggtaaaatgggagaattgtaaggggagtttataggttttaaaaggttatgttgtagtaggttttaatttttttaaagtgtgttgtggaatgggatattggtgttgagtggggtaagggtgattaggttttaatgagatggtaaggggtgtatgattggttattaaggagggagtagaggtattttatatttgtgggttaaggtggggggatgtaagaggaggaagtaaaggaggttttggattgggaagaatggtagtaatgagatatagttgtagtttaggaatagttagggaagtagataatttagttaaagtgttttagtttaataagggaattgggtaggtggggataattgaaaaggagtgtttgaaagagtattgtttaagttggtattagagttggggagttttaagaggtttagaagtttagttgttaatatttataatagttatggaggtaagggaaataggtttttgaaaagaaggtaatgtggagtgggtagtttttatattgattaagaaggggatgggtttattttttattgtgagagttatttagattgtgatggttttgtaggtttttgaggtgattgggattgggtagtgttagtttttagttgttaagttgagaagatttgggaaggagttagagagttttgggttagagttttagttgttttgggagtggttgttaggtgagttgaatagtttgatttttagtggggttttgtatagatgggatgtggtttaggaggaattttaggttgtggatattttttggtttagtggttagatttttagtatttgtagtaagtttttgggggaagaggttttggaggaatttttggtagttgtggtttaggtgtttggagtttttgtgtgttggagatgtggttggggtttgttttatttggatattggagtggaggtaaggaattgtaatttagaaatatgttgttatttggttgtttttattttattattgtatattttgaaggtgaggttaattaagttttgttgtggggtttgagggatagaatttaatttttggagttttatttaatgttgggagtagatttggtaataaaatgtatattgagaataagatggttttttgatttagggtttagggttgtaaagtgttttagggttgttgttaaatgagttatgaattgggttgtgtttttaaatttgatgaaaaagagtttaaatattatttgatttgggagaggttagataaagaaaaaggagtattaattttgattatgtttttagttttagttatttttttaagaggaaattgttgggtagttgggggagggttagttatggaatggaattgtaagttggattgggtgtgaggaggggaggtgataaaaggattatagggtggaggagtggaggttgaggaagaattgggatttagtttggtttggtgaggaggggagatgttagatgggtttgtagaaaaggaagattagaaagatttagtgatgtttggggttgggattgatgggataggtgggagggaaagaaggaagatttgggatgagttgtattgggtatagagattagggagggattgatgtgtaaaagaatgtttggatgttaggtattttagattatttgtttattttataataagaattatttagattttgtaggatggaaaaattgaaagtgttgttttttggttatttggaattattgttaagtttgtattggggttaagtagtattgtagaagaaaataaggtatttaggttttaggttaggtgtgagttgaagaggttttaggtttttaagaatataggttaagggagaagaaggaggaatggagggtggaaggttgtttatattgaaggaggtaagtatagagaaaagagagagtagagatatggagggaaggggtttaggggtttttattttttagaaaagtgggaaaggggttagggtatagaagtaagggattggggtgtagagataagaggttggggtgtggaaataagggattggggtgtagagataagatgttagggtatagaaataagggattgggggatttttgttttttagaaaagtggtatttgttattaagggtgaaggagaaggggttggggggtttttgtttttttagaaaagtagagaaggggtagagatatagagaaggagttgggggtttttgtttttttagaaaagtagtatttgttattaagggtgaaggattaaggtaggtatttttatgtggttagatatttttgaaatgtgggtgaataattagagaggtgtttttgtgtgattaaatattaagggaaggttgtttttttgagtttatgattggtgttggagttttgggtttatgaataaagtgtgttttttgtttttattagaaaaggaaaggaattgaaattaagagaagggagagattgaagagtggaaaggagaaagtggttgagggatagtgagagaggttggagaagagagtaaaaagaggttgtttattggatttaaaattggtgagatgttttttgggttggttggtttgaggatgagaggttgtaggtggattttttttatggagtaaagagtaggaggataggggattgattttttaaggaagattttttgatttgagttatggtattaaattttatttatgtttgtgtgaagagattattaaataggatttgtgtgagtaataaggttgtttattttatttgggtgtaggtgggttgagtttagaaagagagttagtaaagggagataggagtgtggttgttttataggatttgggtaggtaaaggaaaattatagttaaaagggggttgttttttggtgggtaggagtggggtttataaggtgtttagtaggggagtttttgagttgggatgagttaggagaaggaattttataagataatgttattatttaaggtaagaataggttatttttattttttttgtggtggaatgttattagttaaggtaggaattggttatttggatgtgtatatataggttatagggggatatgatggtttagtttgggtttagaggtttgatagtttggattatttgatttggtgatttgtatattttggttttttaaagtgttgggattataggtatgatttattgtatttggttttagaaaattttttaaatattaaaatgtatgttatgtgtattttgttataatttttgaaaagtattttttggtgtttagagatagaagatgagtggttgtttagggttgggagagtgaggggattgtggtgatgggtagttggttggtatggggttttgaagggtagtgatgataatattttaaaattagattgtgttgatggttgtattaattttgtgaatattataaaatttaaattattgaattatgtatttttaatgggtaattgtatggtatgtaaattatattttaataaagttatatttttaaatattaaaaaaaggttgggtgtggtggtttatgtttgtaattttagtattttgggaggttgagaagggtggattatgaggttaggagatggagattattttggttaatatggtgaaattttatttttattttgaaaaaaaaaaaaaaaaaaaaaagattatttggatgtggtggtgggtatttgtagttttagttatttaggaggttgaggtaggagaatggtataaatttgggaggtagagtttgtagtgagttgagattgtgttatttaggaggttgaggtaagagaatggtataaattttggaggtagagtttgtagtgagttgagattgtgttattgtattttagtatgggtgatagagtaagagtttattttaaaaaaaaaaaaaaaaagattagtaatattttttgtgttatttattatttaagtgattgaattatgatttgaaatttattattttaaatatggtttagagtttgtagaggggggatagttttaggaatgttggtgtgggtttaaggttgaattaaatagatttagatggtttatatttgtaattttaatattttgggaggttgaggtaggtgggaggttgaggtaggtggattattggagtttttggagtgaagaaaggatgttagtggaaaaattggtgaaattagaataaagtttatagttttattttttaaaggaggttgggtgtggtggtttatgtttttaattttagtattttgggaggttgaggtaggtggattagttgagtttaggagtttgaaattagtttggttaatttgatgaaattttatttttattagaaatataaaaattagttgggtgtggttgtgggtgtttttaattttagttatttaggaagttgaggtaggagaattgtttgaatttaggaggtggaggttgtagtgagttgagattatattattgtattttagtttgggttatagagtaagattttatttttaaataagagagatatgataattaaataaattgtgtaattttggattaaattttaaattaaatatatgttattggtaaaataagtggtgaaatttgaataaagtggatagattagataatagtgttatattagtgttattttttgattttgaatattaataatagaatgtttttggttttgggaaatataatttgaagtgattagaggtttagggtattatatgtaaattagatatattttttttggggagagagggagagggagagaggttgaatgatgaagtaaatgtggtaaaatgttaattttggggaaatttggatgaagaaattatagattttttttttttttatagatagggtaatattttgttatttaggttagagtgtagtggtatgattatggtttattgtagtttttatttttttgggtttagatgatttttttattttagttttttaagtagttgggattataggtgtatagtattatatttggttaatttttgtattttttttttttttaggtttgttttaagtaatttatttattttggttttttaaagtgttgggattataggtgtgagttattgtatttggttagaaattttttaaattatttttgtaagtttggaattatgttaaaattaaaagtttaaaataataaaagataatatttttatatttttttggtgaaggtaattatgttatggttgagagggtggttgaggtttgaggatttagtttatataagttttttttatagagggtatttaagtgttttgtagggggaaggataaagaaaatatttagagttatgatagttgtgtaaggggaaatgttagtattgagtattgaatttttagtaaataagaaggaggtgggttgggtgtggtggtttatgtttgtaattttagtattttgggaggttaaagtgggttgattatttgaggttaagagtttgagattagtttggttaatatggggaaattttgtttttattaaaaatataaaaattagttgagtgtggtggtatatgtttgtaattttagttatttgggaggttagaataggagaattgtttgaatttaggaggtgaaggttgtagtgagttgagattgtattattgtattttagtttgagggatagagtgagattttgttttaaagagaaaaaaaaaagaattagtatatttgtttgttttaagaagatataattagttttgtatagtagttatatgtatttattaggatatattttaaggttttagtggatgttgaaaattatatagtattttatatgtatatatatatgtatatatatatatatatatatatgtatatgtatatatatatgtatatatgtatgtatgtatatatatatatgtatatatatatatatgtatatatatatgtatgtatatatatatatgtatatgtatgtatatatgtatatatgtatgtatatatgtatatatgtatgtatatatatatatgtatgtatatatgtatatatgtatgtatatatatatatgtatgtatatatgtatatatgtgtgtatatatatatatgtatgtatgtatgtgtgtatatatatatatatgtgtatatatatgtatatatatgtatgtgtatatatgtatgtgtatatatatatgtatggtattatgtagtatatatatatatatatgtatatatgtatatatatatgtataaatgtatatatgtgtatatatataaaaggtatatatgtatatatgtgtgtatatataaaatgtatgaatttttttttttttattgtagattttaataatttttgtatagaatttttttttattaagtggagagttagttatttatttaaaagaaatgttttttggttgggtgtggtggtttatatttgtaattttagtattttgagaggttgaggtaggaagatttatttgaggtgaggagttggagattattttggttaatgtggtaaaaattggtttttattaaaagtataaaaatgagttgggtgtggtgttgggtgtttgtagttttagttatttaggtggttgaggtaggagaattgtttgaatttataaggtagaggttgtagtgagttgagattatattattgtattatagtttgggtaatagagtaagattttgttttaaaaaaaaaaaaaaaagaaagaaaaagaaaaagaaaagaaatgtttttttttttattaagttttttaaatgaaaagtttttttttttatttttattttattgaaatattataatattatttttgaagaagttagtgttattattttattttgatgaaattaattaatttatttaagtatatgtatattgtatatagagaagttaatgttaaaatttttatttttatttttttagatttagtagatatatgtgtaggttttttatgagtatattgtatgatgttgaggtttgtattaatgatttagttattaaataggtagatttttaagttttgtttttttttttatttaatgtttagtgtttttatttataagtgagaatatgtggtatttggttttttttttttttttttttttttttttgagatggagttttatttttgttgtttaggttggagtataatggtattattttggtttattgtaatttttattttttaggtttaagtaatttttttgttttagttttttgagtagttgggattataggtatgtgttattatatttggttaattttgaatttttagtagagatagggtttttgtatgttggttaggttggttttgaatttttgatttaaggtgatttatttgttttagttttttaaagtgttgggatgataggtgtgagttattgtgtttggttagtatttggttttttgtttttgtgttaatttgtttaggataatggtttttagttgtatttatgttgttgtaaaggatataattttgtgattttttaaggttgtatagtgttttgtggtgtatatatattatattgtttttatttagtttatttttgatgggatttgggtggattttatgtttttattattgtgaattttgttgtaatgaatatataagtgtatgtgtttttttggtagaatgatttatttttttttggttatatatttagtgatgggattgttgggttgaatggtaattttgtttgtagttttttgaaatatttttaaattaaattgttttttatagtggttgaattaatttatatttattaatagtgtataagtgttttttttgttttataattttattagtatttgttaatttttggttttttagtaatggttattttgattggtgtgagatggtattgttgagggataatttaggaattagagagattgaggggttgaggaggatttattattattattattatttaggtgtattggttttagttagattaatatttaaaaagattgaggtttgaatagagagtttggttattttttaagtattttgtggggttgggggagatttgtgtagggggaagtatattatagaagtaagaaataaaggtagttatttaattgagatatgtattatattattttttattttttaagaaaaatatgttttatgatttgaggttattttgtttagtgattttgtagttgtatggtaagagaaatagggtttttataatgtttgggaaagggagagataaggtttattagttatagatagaaaaataggtagtttatgtttaaaggattttattttttttttttttttggggggaattgggtttttttaaatataattgagtttttgtttatatattttgtaattttttttaatttttgttttagtattttattgtgaaattttttatgtttttatatgatttttagggggttttttttgggtatgattgggtataattttttatagttagttttgggtatgatttttatattgtagaattgagaagttgatttagaaatgtattttgggttgagtagataattgttagagttgttggttagattatagatgtgttagagggattatggtttttttgtaagtttatggttagaggtggaggggagttgtgaatgttttgatgaaagtagttaatgtgaaagtgttttggtgatgggtgttggtgtttatttattattttttgtgtatttatttttttggtttgtttggtttagtttttattgtttagtattaggttggtagaatttgagtgatgttttttatattttttgttttgttttgtgttggtgagttttggtgtggaaggggaatgggattatggtgtgtttgggaggtaataggttttattatttttgttttttagggttgtgtttgagttagaggattagtgtttagtagtgtgagttttttttttaaagtttagggttatttttttgggtttaggttaagttttttttatttaagtatggttggggagaggggatagggtgttggttttttaggagagtttggggttagtagttgggtggagtttaaggttggggggagggggttttgttggaattttagtttttgatttttttttagagatttttttaaaattgtttatttgggttgagttttattttatggttttaaaggaaaagtaagtgattatttgttgttagggaaattatggggttgttgaatattagttgtattttgaaggaagtttttttgttgtggatagattaaaattttttgagtggattaataaagttaaattttatattttggatatgaatttttgtatggtagggtaatatagttgtatttattgggttggggagttttggttagagtttagtaatttgttggatttggtggtaataggtaattgtttggttttttaattggagagtgattttagtttgtatttgggatgtagtattatttatgaatttttttaagttttatttagatattgtttgttttggtaggaggttggaaggaggggtgatttttattataatttttgtttataaggggttgtttgtagattgtgtttttatgttttaggagtagatgtgtttttagttagtttttttatgatatagattttgagatagatatttgtatgtaggggtatgattgaggaatgtttttaaaaataatgtttgtgggttaggtgtagtggtttatattttgttttttttatttattataggtggtgggttttttttttttttatttgttttgagatggagttttgtttttgttatttaggttggagtgtagtggtgtaatttttagttattgtaatttttattttttgggtttaagtgattttttagttttagttttttaagtagttgggattataggtatttattattatgttatattttgtatttttagtagagatggggttttattatgttggttagggtggtgttgaatttttgattttagatgatttgtttgttttatttttttaaagtgttgggattataggtgtgagttattatatttagttaggtggtggttttttaaaaaaaaaaaaaaaaattagttttttttttttttaataatatggttgtttattattattattaagtattatatatagttatatatatatatataattgtatgtgttatataattaggtttgtttatattagtaatattaaaaatatatgagtaatattttgtgttaggaaggttatgatgttattaggtaataggaattttttagttttattataattttatgggattattattatatatgtggtatattgttggttaaaatgttattatgtagtttataatagtattttatgtttatttaaatatttttttttgtgaaatgtttatttaaattttttgtttatttttaaattgggttgtttatattttgattgattaggaaaagttatttttatattttgtgttatatatttgtgttgaaatatatatattttttgtttgtgtttttttatttgtttagggtttttggattttgtttggaggttttggtaggggaatatagttatttatttatttttttttttttaatttttttagtatttattgattatttttgggtgttttttggagagggggatttggtagggttataggataatagtggagagaaggttagtagataaatatgtgaataaaggtttttggtttttttaggtagaggtttttgtggttttttgtagtgtttgtgtttttgggtatttgagattagggagtggtgatgatttttaaggagtatgttgtttttaagtatttgtttaataaagtatattttgtattgtttttaatttatttaattttgagtggatatagtatatgttttagagagtatggggttgggggtaaggttatagattaatagtattttaaggtagaagaatttgttttagtatagaataaaatggagttttttatgtttatttttttttatatagatatagtaataatttgattttttttttttttttttatattttttttttttttatttgataaaattgttattgttattatggtttatttttaatgagttgttgggtatattttttagatggggtggtggttgggtagaggggttttttattttttagatggggtggttgggtagaggtgtttttttattttttagatggggtagtggttgggtgggggttgttttttaattttttggatggggtggttggttggggttttttttttttttttttgagatagttttgttgtagtgtagtggtataattttagtttattgtaatttttgttttagttttaatttttttgttttagttttttaagtagttgagattataggtatgtgttattatatttggttaatttttgtatttttagtagagatggggttttattatgttgattaggttggttttaaatttttgatttaggaggttgagtttttagtaagtaaagatagtgttatggtgttttagtttgggaaatagagtaagattttgtattatttttaaaaatggttttagatggtaaattttttattgtgtgtatttgattaaaataataattaaaaaaaaaaaaaaagttggttgttaggtatggtggtaggtttttgtagttttagttatttgggagggtgaggtaggagaaatgtttgaatttgggaggtagaggttgtagtgagttaagattgtgttattgtattttagtttgggtgatagagagagattttatttttaaagaaagaaaaaaaaaaatagttggttgtttattattgagtttttggtgtggtggttttatttttttttatagaaatgtatgatatatttatttttttggtttattttggatttgaagtgattttgggagagaaggtgattttttattgttgtttagatattgtaataagtatgtttttattgtttaaggagggaagatttagttatgtatagtgtggatatgggaaggtttaggtggagttttttttgggttttgtgattatagtttattgagggatatattgatgttttggtttttataataattatgtttggtttttttttagtgagttagtgaagtttttggttataggtgaggaaatgtttaattttttatattttttgttgttatgttttatttggagttttgagggatttttagagagtgatggggagggtgtttaagggatgtttattttttgggtgtttggttggttatgtgaggaagaatattagaagtaggaaggaggagggagtagagaaaggaatggtaaggtgggtggattataaggttaggagtttgagattagtttggttaagatggtgaaattttgtttttattaaaaatatagaaattagttagatgtagtggtggatatttgtagttttagttatttaggaggttgaggtaggagaattgtttgaatttgggaggtgggggttgtagtgaattgagattatattattgtattgtaatttgggtgatagagtaagattttattttaaaaaaaaaaaaaaaaaaaaaaagaatggtaagattggaggaaattaaaaatttttatttttttttttttatttttttttttaggtgatattgagaatattagttttgtatttgaagattttattttttttggtgagtaattggtttttttaagtttagatgagtgattagagttttttagtgatattaaaaatgtggtatttatttaaaatatttattgaggttaggtgtggtggtttatgtttgtaattttagtattttgggaggttgagatggtgtattatttgaggttaggagtttgagattagtttggttaatatggtgaaattttgtttttattaaaaatataaaatttaggttgggtattatggtttatatttgtaattttaatattttgggaggttaaggtggttggattataaggttaggaatttgagattagtttgattaatatggtgaaattttatttttattaaaaatataaaaattagttgggtttggtggtgtttgtttgtaattttagttatttaggaggttgaggtaggagaattgttgaatttgggatgtagaggttgtagtgagttgagattgtgttattgtattttattttattgtatgatatagtgagattttattttatagaaaaataaaaataaaattattatatatatatatttattaagtgtatagtatatatagtgaattatattgtaatagttagttaggtagatattttgattttgtagtatttagattttagtaggaggagatatattattggttaatgttaggatagtatataggagggaatgatgttatggaaggaaaagataaagtagaatagatttatagtgattgaaatggtagttagtaatattaaataggtttgtttagatggattttatagagaaagaaggtatttgagtaaatgtgtttagatttgagttaattatgtggttgttaggagaaaggaggttttggagagaatgaaatggtatttgtttgtgttttggggtaggaagataattggggtaatataataataattatgaggttaggagggttgaaaatgatgtttggaagatgatggtgggatgggtttggggtgtatggttaggattataggagtgaggtttggtgtggtggtttatgtttgtaattttagtattttgggaaattgaggtaggtgggttatgaggttaggagattaagattattttggttaatatggtgaaattttgtttttattaaaaaaaaatataaaaattatttgggtgtggtggtgggtgtttgtagttttagttatataagaggttgaggtaggagaatggtgtgaatttgggagatggagtttgtagtgagttgagattgtgttattgtattttagtttgagtgatagagtgagattttgttttaaaaaaaaaaaaaaagaaaaagaaaaagaaaaaaaaatagtgagattttgaattttattatgtgtgtatgtgtgaggagaaagaggtaatgatgatttaatgaggaaaatgaggtttaaatagaagatgggttgggttgggtggtttttgtatgtaattttagtattttggaaggtaggggtggttggattatttgaggttaggagtttaagattagtttggttaatatagtgaaattttatttttattaaaaatataaatatgagttgggtgtggtggtgtatgttagtaattatagttatttggggttgaagtaagaggattgtttgaatttgggaggtggaggttgtagtgagttgagattatattattgtattttagttttagaggtttgttattttagttttttgggaggttgaagtaggtaggttatttgaggttgggagtttaagattagtttggttaatatggtaaaattttgtttttattaaaaatatgaaaaaaattatttgggtatgtggtgtgtgtttgtagttttagttattttagaggttggaatatagtgagattttattttaaaaaaaaaaaaaatagaagatatgattggtgtaaagatatatgtttataagtgttagaatggaattttttgttaggtttgtttatttgtggatttttttattttatttgttggatgaagtttttgggatttgtagggtgaggtgggattttgtaaagttgtagaatgttatggggtagatttaagggaaggagtgttggggtggaggaggttaaaattatttttttttttttattttttttattattagtagatatttggggtatttattttttaattatagagatgggattttagaaaggtaagtagatagttggggttataggttttgaaggaaggggttgggtatagagtagatttaggaagggaatttaaatgggaataagagggtgtttttggttaggtgtagtagtttatatttgtaattttagttttttgggaggttgaggtgggtagattatttgaggttgggagtttaagattagtttggttaatatggtgaaattttatttttattaaaaatataaaaaaattagttaggtgtggtggtgtgtgtttgtagttttagttatttgggaggttgagataggagaatagtttgaatttaggaagtggaggttgtagtgagttgagattgtgttattgtattttagtttgggtgataagattgaggttttgttttaaaaaaaaaaaaaaaaaaaaaaaaaaaaaaaaaaaaaaagagggtgtttttatatttttgttagtgattattttgtttttttgtttatagattatgttttttgggattatattgtttagaattttttttggatgggtttggtttttttagttttggtggttttagtgtggtttttggttgaagattggtttagtaggaagaggattagagagtgagttagtagagtttttatttgggaaggtaggagaaggttgaatatatagattttttgaagaatgattatgagatatagtggttatgggtggatttgaaagttggtgttgagtttgggtggtgtgagttttgtgttggatttatggaggagggagttattgtagggaaagagggatattggtattttatttgttagagtattttggatgatgtagagggtgggagaattatatgttaaatttttttttttttttttttgagatagagtttttttttgttgtttaggttggagtgtaatggtgtgattttggtttattgtaatttttagttttttattttttgggtttaagtgatttttttgttttagttttttgagtagttgggattataggtatgtgttattattttagttaattttgtatttttagtggagatggggtttttttttgttggttggttttgaatttttgattttaagtgatttttttgttttggttttttaaagggttgggattataggtataagttgttgtgtttagttattgaattttttttgtagataaattttatggttttttttaggttttaattatttttgtattatttattgtaaattatatttttaattattttggttttttttgaaaagatttttttttttttaataggatggttatggaaatattttttttttattttggttttttttttttttttttttttgtaggaagttatttaaaatagttaataattaatatagaataggtttgtattaaatggtttaggaggtattgtggtaataattagttgtagagaagtagttttataagtgaattttgttaggtatggtggtttatatttgtaattttaatattttgggaggttgaggtgggtagattatttgaggttaggagtttgagattagtttggttaatatgatgaaattttatttttattaaaaatataaaaatttggttaggtatggtggtttatgtttgtaattttagtattttgggaggttaaggtgggaggattatttgaggttaggagtttgagagtagtttggttaatatggtgaaattatatttttattaaaaatataaaaattagttaggtatggtggtgtgtgtttgtaattttagttatttaggaggttgaggtaggagaatagtttgaatttgggaggtggaggttgtagggagttaagattgtattattgtattttagtttatgtgatagagtaagattttgttttaaaaaaaaaaagaaaaaaaaaaaataagtgatttttggttgtattttaattatattttaattttttttaattatagaattattttatttttttttttttttttttttttttttttttttttgtttgttttgttgggatagaattttattttttttttttttaatgtaagttttagggtatatgtgtataatgtgtaggttagttatatatgtatatatgtgttatgttggtgtgttgtatttattaatttgttatttaatattaggtatattttttaatgttatttttttttttgagttttatttttgttatttaggttggaatgtagtggtgtaattttggtttattgttatttttatttttagggtttaaatgatttttttgttttagttttttgaatagttgggattataggtatgtattattatgtttggttaatttttgtatttttagtagaaatggggttttataatgttggttagattggttttgaatttttgattttaggtgatttattagttttggttttttaaagtgttggaattataggtgtgagttattgtatttggttattatttttgtttttttatttatattttgttttgttttttagggttttgtagagatattattttttttaagagtttttataattttgattttataaagatagtatttttttttttttttttgagatagttttattttgtagtttaagttggtgtgtagtggtataattttagtttattgtaatttttgtttttggggtttaagtgattttttttttttagttttttaagtagttgggattagaggtgtgtgttattatatttggttaattttttttgtatttttagtagaggtagggttttattatgttgttttgggtggttttaaatttttgagtttaggtgatttttttgttttggttttttaaagtgttaggattataggtgtgagttattgtgtttagttaagataatattttttttattttaaagtatttgttaattttttgtaatagtatttgaattttgatttggtatgtatgtttatttttttgtttttattgtgaatttgtgtgaattgatttatgttagatttagtggttgtatttatagtttttgtaattataatggggtttttgggaaatatatattaaatgagtgaatgtatatatggggttgtggtatagtttgtaatttgagattttttattaggggttttgaaatgttgtttggatattattattgtttttttttttgagaatttttatttattaatttatttatatatttattgtatgggtttttatgtttttttattattttggtgttttatgttggttaaatttattttttaaatttgatttttttattaaatagtagtttggttaatatggtaaaattttatttttattaaaaaatataaaatattagttaggtgtagtggtttgtatttgtaattttagttatttgggaggttgaggtagtagaattatttgaatttgggaggtagaggttgtggtaagttgagattgtattattgtattttagtttggtaatagagtgagatttttttttaaaataaataaattgttgatttgtgtattttttttttattttaatttattttttatatgtaggtatttgtaattttagttatttagaaggttgaggtaggagaattgtttgaatttgggaggtggaggttgtggtgagttaaaattgtgttattgtattttagtttgggtgatagagtgagattttattttaaaaaaaaaaaaaaaaaaattatataggtttagtttttttagtatttgttttattggtttagtaaaagttaggaaatataattttgtggtaatttgaatgttattgaattgtattttgtttattttattgtaaatattagtgaatagtgaataaatggttgtatatttttaataagaaaaaaaaaaaaaaagatttaaagtatagtgagttgatgttgattttattttgtagaggtttgtttgtttttttttttttaagagtgtaattttatgtttaataaatttatgttgttttgttatgtgtgtgtattatatttaattttttgtttgaaatattaagggtttggaattttatagttttggttggtaatggggagtaggggtaaagatatttaaaagttgtttgtgttaattataattgttattttatatattagatttttagaattaatttattttataattgaatattgtgttttttttttttttttttttttgagatgaagttttgttttgttatttaggttggagtgtagtggtgtgattttgattttgtaatttttgttttttgggtttaagtgatttttttgttttagttttttgagtagttgggattataagtgtgtgttattatgtttggttaatttttgtatttttagtagagatggggtttttttatgttggttttaaatttttggttttaggtgatttatttgttttggttttttaaagtgttgggattatagatgtgagttattatatttagttatttgtgttttttgattaatattttttttttttattatttttagtttttgataatttttatttatttttatttttaggagattaattgttttatttttttttttttttttttttttttgagttttgttttgtatatttaggttggagtgtagtgttgtaattttggattattgtaatttttgttttttgggtttaagtgatttttttgttttagtttttagagttgttgggattattgagttattgtgtttagttagaagatttatgttttttaagatataatttatattggtggtttttgttttgattttttatttgtgttttttatttgttagaaattggtttttttttttatattttttttgaagttgtttgtgtgattaatattaatgagttttttttttggaatatgtagtgattttttttagttttttttattattgtttttttatagttgtatttgatatgttgattattttttttttgaaggatttatttttttggtttttttggatattttttgttatttgttttttgatggttatagtattaataggtttgtaggtatttttattattagagttaattttagttatttgggaggttgaggtaggagaattgtttaaatttgggaggtagaggttgtagtgagttgagattgtgttattgtattttagtttgagtgatagattgtgattttttaaaaaaaaataaaaataaaaataaaaaaattatagttttgttttgttgtttaggatggaatgtagtggtgttattttggtttattgtaatttttgtttgttggggtttagtgatttttttgttttagttttttaaggagttgggattataggtatgtgttgttatgtttggttaatttttgtatttttagtggagatgggggttttattatgttagttaggttggttttgaatttttgattttatgtgatttgtttattttggttttttaaagtgtgaggattataggtttttgtatttagtttaggattttgtatttttttagtttagtagttttttgttgggtgattttgttttttattttaggggatatttggtaatgtttatggtaatttttaattgttatgatttggggaggggttttattggtatttggtaggtagggtttaggggtgttgtttagttttttataatgtttagggtagttttagatggtagtagtattaaggttgagaaatattggtttatgtagaaagtaattattttatattttttagtgtagggataaaggtagggttatgagtttatggaaattttttagttttagtttatgtaagatgtggttattttttttttttattgtttttatttatttattttttttgagatagagttttgttttgttgtttaggttggattgtagtggtgtgatttttgtttattgtaagttttgttttttgggattatattatttttttgggattataggtgtttgttatttagtttggttaattttttgtatttttagtagagatggggttttattatgttagttaggatggttttgatttgattttgtgatttttttgttttggttttttaaagtgttgggattataggtgtaagttattgtatttggttttatttatttattttttgagatagagtttgagttttttattttatttatttagagattaagttttgttttgttatttaggttggagtgtagtgttgtggttttagtttattgtaataatttttgttttttgggtttaagtgatttttttattttggttttttaaagtgttggtattatagatatttattattatgtttggttaattttttgtatttttagtaagtaaagatagggttttattattttggttaggatggttttgaatttttggttttaagtgattggtttgtttgggttttttaaagtgatgagattataggtgtgagtgattatattggtttaatgtgtagttttttatttgtggttttttttttgtttttttttttttgagattttgaagtttattatattattttgtttttgtgtattaatagtttagtttttattgagaatatatagagttaggtatggtggtggtggtttatgtttgtaattttattattttgggggtgttgaggtaggtgtattgtttgaggttaggagtttaagattagtttggttaatatggtgaaattttatttttattaaaaatagaaaaatatatagttgggtgtggtggtatgtgtttataattttagttattagggaggttgaggttggagaattgtttgaatttaggaggtggaggttgtggtgagttaagattatattattgtattttagtttgggtaataagagtaaaattgttttaaaaaaaaaaaaaaaaagtgagaatatatggattttatttttgttagaataatggtttttagttttatttaaattgttggaaatgatattattttattttttttaatggttgaatagtattttatggtatatagatattatgttttttttatttattgtagggattagttttatagggttggtgggtttttttttgtgtgtggtgatgagagagtgtagaaataaagatataagataaagagataagagaaaaggtagttgggtttgggggattattattattaatgtgtggagattggtagtggttttgaatgtttggttgtgttgttatttattggatataaggtagaaggggtagggtaaagagtgtgagttatttttaatgataggtaaggttatgtgggttatgtgtttattggatagggggtttttttttgtttggtagttgaggtagagagggagaggagatagagagaaagatagtttatgttattatttttgtatattagggattattagtattttttttaatttattattgttatttagaaggtagagttaggtgtataggatggaatatgaaggtggattaggagtgtgattattgaagtatagtattatagggagatggttaggtttttggataattgtgggtgagtttgattgatgttaggttttttataagaggtggaggagtagagttttttttaaatttttttggggaaagggagatttttttttttatttgttgttttttttttggtttgttaagtagtgggtgttgttaattgatattttttgttattgttggattatgatttgtttggtgatgggtgtttttttagatgttggtgttattgttagattaaggagttttttggtggttttgtttgggtataatagaaggtttgtatttttgttttttggttatattttattatgtttttttagtttttatttttgtatggtttggttttttttaggttatgattatagagtgaggattattataatattggaataaaaagtaattgttattggttaatgattaatgatatttatatataattatatttaagatttatatttggtataataatttttgttttatattttattatattggaatagtttgtgttttttgttttttgttttggtgtttgggtgttttgttgtttataatttatttattatttaatgggtattttggttggttttatatttttgtaattgtgaatggttgagttagttatttttaattgggggtgattttgtttttatgggggtatttggttatattttgagaggttttttggttgttatgagttgtagtgggggtaggtttaggtttatttaagtttaggggtgttgttatatattatgtgatatataggatagtttttgttatggattgaattggttttattaaatgttatgtataagttttattttagatgtgattttatttggatatagggttttttagaggtaattaaggttggttaggtgttgtaattatagtattttaggagttttgtgtttattattggtaagtgggtaagagtttagtgtggtagtttatgtgtgtaattttagtattttgggaagtgaaggtaaggggataattggaggttagtagtttaagataagtttggttaatatagtaagattttatttttataaaatattttaaaattagttaagtatgtttggtatgtatttgtaattttagtttaggaggtttaggtgggaggattttttgagtttaaggttgtagtgagttaagattgtattattgtattttaatttggttgtgggtaatatagtattattattattttggttgggtatggtggtttatgtttgttatgttagtattttgggaggttgaggtgggtggtttatttgaggttaggagtttgagattagtttggttaatatggtgaaattatgttattgtattttagtttaggtaattaagtgagattttgtttgttttattattttattaaaaaaaagattattattttaaataaaattaaaatttttaagtagataaaatatttaggggaaaaaaattttaattaaatatgtagtagagtttgatttagatgtttttatttttagtttttatttattatttttgtgtttttatttttagtaaattttatatgggaattttatgtgtatgtagaattttaaatgttgatttagttttattttttattatttgattattttttttatttatgttgtttttattattttttttattggtgtgagttgtattttgttaaatattgttattatttatagtttgtattattattagttgattgtagttttaaatattatagtgattttgagtatttgagaagatttattttgataagggtttatgaaagatagtaatgtttaatagtaagataaatgagggtttttatgggattatttagtgttgaagttatttaatttttaggtttgggttagtaaaaagaattttgttaggttaggtatagtggtttatgtttgttattttagtattttgggaggttaaggtgggtagattatttgaggttaggagtttaagattagtttggttaatatggtgaaattttgtttttattaaaaatataaaaattagttaggtatggtgatgtatatttttagttttagttattttggaggttgggatagaagatttatttgaatttaggaggtagaggttgtagtgagttaagattgtattattgtattttagtttgggtgatagaggtaagattttattttaaaaaaaaaaaaaaaaaaaaaaagaaaagaaaattttgttatataagtttttaatttaaagtattagttatatgtttgtgtttttgtgtttgggattatgataattttttttatattaatgtttttatttttttttttttgagataagagttttgtttttattgtttaggttggagtgtagtggtataattttagtttattgtaaattttgttttttgggtttaagtgatttttttgttttagttttttgagtagttgggattataggtatatattattttatttggttaattttgtatttttagtagagatggggtttttttatgttgaggttggttttgaatttttgattttaggtgatttgtttgttttggttttttaaagtgttgggattataggtgtgagttatagtgtttggttgtttttattaaaatagttttattatttattgtaagtgtggagagttaagtgaggagaggggttagttttttttggtagtgtttggaagttagtgttaatattatggtgataattttttatttttaaggaaaattgtggagtgatttttatgtattttttatgaatgattaaatatagggtgtggaaaagttgtgtttgttatggtaatgggaagttgagagaaatggggaggtgagagagatagagatatatatagagatttttagagatagttatatagatttatatagaaatagatagataggttgggtttggtggtttatgtttgtaattttattattttgggaggttgaggtgggtagattatttgaggttaggagtttgagaatagtttggttaatattgtgaaattttgtttttagtaagaatataaaaaattagttaggtatggtggtatagggttgtaattttggttatttggaaggttgaggtaggagaattatttgaatttgggaggtgtggttgtagtgagttgagattatgttattgtattttagtatgggtgataagagtgaaattttgttttaaaaaaaaaaataaaaaaaaaaaatgaaagaatagagagatatatataaagatagagatagaaatgtttagtgatagagatatatatagagaaatatagatagatatagagatatatatatagaaatagatatagagatagagagataaaaagatagatatagagaaataaagagagatatatagagatagagagagagagagatatatatatatatatatagagagtaggaggtggtttgtgggagttgagtagaattagtgtgaggtagggttattttttgaattaaaggtaatagtgattgtaagtttgtgttttgtgagtaataggatagattagaatagggttggttgtttatggtttatgagttgtttttgggaagtttttgtaggtgttagttaggttttgtgttgtttttatgtttaaaggtatagttgagagttgatgagagattgtggggtttatagtgttaagtatatgaattatttggtttgtttgttaatgtgtgggttgattatataagttatgattatataagttataaagatatattgattatatagatgtatttggtagatagtagattatatggtgtttgagttagggaagaaaagaaatagaagaattaattgaattatttttgaattttttagtaatatttttttttagataaagtatagagtattatgtttattgtaggtttgtttttgagtatgttaataaatgtagttgtaatgagagtgttttaattttattatttttgtgagaaagtatatagtgttatgtgaagggggtgtgtgatttgtgtagaattttttaaaaatagtgagaaaattagtgttaaattttattttttgatagattttagtgttaatatgtgattttttgatttgtatttataagatattttagagatttgaattttgttttttgtgtaatttgtagagtgattttaggttgtttagtaaaaaaagttatagtatggaggtgttgttgttttggaagtattgtaattaatagttagtttgggattttttttttttattttttttaatagttttttgatttttaaattagttttataggtttttaatttggagggattagagaatataaatgtttttagaaatttatttttaattatttaggatgtttgaatatttgtttttaaatatttaaagtaggaaatgtttttgggattttttgggggatagggttttgttttgttgtttaggttggggtatagtggtgttattttggttttttgtaatttttagtttttaagtttaagtaatttttatgttttaggtttttgagtaattgtgattataggtgtgtattattatgtttggttaagttttgtatttatagtagagatggggttttgatatgttagttaggttggttttgaatttttggttttaagtgatttatttattttggttttttaaagttatgggattatagatgtgagttatagtatttagttagaaaagttttttaaaaagaaatttagatttatataatggggatttttataagtttaagaaaaaaaagattatggttaggtatggtgttttgtatttgtagttttagtattttgggaggttaaggtaggtagattgtttgagttttgtagtttaaggttagtttgggtaatatggtgaaattttgtttttattaaaaatagaaaaagttagttaggaatggtggtgtatgtttatagttttagttatttgggaggtggaggtaagaggattatttgagtttaggaggtggaggttgtaatgagttagagattgttttattgtattttagtttggtaatagagtaaaatatgtttttaaaaaataaatttaaaaaatagataattaggttggtgtatggtgatttatgtttataattttagtattttgggaggttgaggtgggtagattatttgaggttaggaatttgagattagtttggttaatatagtgaaattttgtttttattaaaaatataaaaattagttgggtatggtggtagataattgtaatattagttatttaggaggttgagataggagaattgttttgaatttgggaggtagatgttgtagtgagttaatattgtattattgtattgtagtttgggtgatagagtgagattttgtttttaaataaataaataaaaaatagtggtaaattaaatttttagtagaattaagagaatgttagagtgaattttagggttaatgatagtaaatttggttttaatgtggttgtagtatgtaagtttgtgtatgtgaatatgaggggtggtgattgtggagatattggtttgttatgttgtttaggttggttttaaatttttggttttaaataatttttttattttggttttttaaaggaggaattgaggaatgagaaaagaaatatgttttaaatatatgatataagagattatagggggttagagatttgttattaatagtttttggtggtattatagattttggttttattaataagagaagtatgatattatttagtttaagttttatgatatatttttaaaattttaatttatttatgttagaggttataattatttgaattgtagatgtgtgaaaaattgtattttgagtaggatataaataatttttatatgtttagtgttttaataatgtaatattgggtattatgaagtagtttatatgtgtattatttttataattaaaataatttttgaataagataagtgggttgtgtatagtggtttatgtttgtaatttgggtattttgtgaggttaagataggaggattgtttgaagttaggagtttgagaattttggtaatatggttatatagtgtagtagagtaaaatgttgttttagaaaagaaaagataaaggtaagaagaaattaaaggtagattatgttaaaataagttattgaggttgggtgtggtggtttatgtttgtaattttagtattttgggaggttgaggtgggtagattatttgaggttaggaatttgagattagtttggttaatatagtgaaattttatttttattaaaaatataaaaaattagttgggtgtggtggtgggtgtttgtagttttagttgtttgggaggttgaggtaggagaatggtgtgaatttgggaggtggagtttgtagtgagttgagattgtattgttttattttagtttgggtgatagagattggagtttttgttttaaaaaaaagatagatttaaaaaaaaagatagattttgttttaaaaaaaagattttgt

SEQ ID NO: 72 - DNA, 30068 bp, Artificial Sequence
  chemically treated genomic DNA (Homo sapiens)
atggagttttttttttgagatggagtttgtttttttttttgaatttgttttttttttgagatagagattttagtttttgttgtttaggttggagtgaagtggtgtgattttggtttattgtaagttttattttttgggtttatgttatttttttgttttagttttttgagtagttgggattataggtgtttgttattatgtttggttaattttttgtatttttagtagagatggggttttattatgttggttaggttggttttgaatttttgattttaggtgatttgtttattttggttttttaaagtgttgggattataggtgtgagttattgtgtttggttttagtgatttattttaatgtaatttatttttagtttttttttgtttttgtttttttttttttgagataatgttttgttttgttgtattgtgtggttgtgttgttgaggtttttaaatttttggttttaaatgatttttttgttttggttttataaagtatttggattgtaggtgtgagttattgtgtatagtttatttgttttatttaagagttattttagttgtagagatgatatgtatgtaaattgttttatgatgtttagtgttgtattattggaatgttaagtatgtgggagttatttatattttgtttaaggtatgattttttatatgtttgtagtttaaataattgtaatttttggtataaatgggttaaggttttaggggtatattatgaaatttgagttaaatagtgttatgttttttttgttggtgggattgaggtttgtaatgttattaaggattattggtgataaatttttagttttttgtggttttttatgttatatgtttggggtgtatttttttttttattttttagttttttttttgggaggttaaggtgggaggattgtttgaggttaggagtttgagattagtttgggtaatatagtaagttagtgtttttataattattattttttatgtttatatatataggtttgtatgttgtagttatgttagagttaagtttgttattattaattttggggtttattttggtatttttttagttttattgaaggtttgatttgttattattttttatttatttatttggaggtagagttttgttttgttatttgggttgtagtatagtggtgtggtattggtttattgtaatatttgttttttaggtttaaagtgatttttttgttttagttttttgagtagttggtattatagttgtttgttattatgtttagttaatttttgtatttttagtagagatggggttttattatgttggttaggttggttttgaatttttgattttaggtgatttgtttgttttggttttttaaagtgttggaattataggtgtgagttattgtgtattagtttgattatttattttttaaatttattttttaaaggtatgttttattttgttattaggttggagtgtagtagggtaatttttagtttgttgtaatttttgttttttgggtttaagtgatttttttgtttttgttttttgagtagttgggattataggtgtgtattattatttttggttaattttttttatttttggtagagatagggttttattgtgttgtttaggttggttttgaattgtggagtttaagtaatttgtttgttttggttttttaaagtgttgggattataggtgtgagatattgtgtttggttataatttttttttttttagatttataaggatttttattgtgtgggtttaaatttttttttagaaaatttttttgattgggtgttgtggtttatatttgtaattttatggttttgggaggttgaggtggatggattatttgaggttagaagtttgagattagtttggttaatatgttgaaattttatttttattgtaaatataaaatttagttaagtgtggtggtgtatatttgtaattatagttatttaggagtttgaggtatgagaattgtttgaatttgggagttggaggttgtagagagttaagatggtattattgtattttagtttgggtaatagagtaagattttgttttttagaaaattttaaaaatgttttttgttttgagtgtttgaaaatagatatttaggtattttgggtagttgagaatgaatttttgggaatatttgtgttttttgatttttttaggttgaagatttatgaaattaatttggaaattaagaagttgttggaggaagtgaaagaaaagaattttaagttgattattgattgtaatgtttttggggtaatggtatttttgtgttgtgattttttttgttgagtagtttgggattgttttatgaattatataggaagtgggatttgggtttttaagatgttttatgaatgtaggttagagggttatatgttaatattagagtttgttgagaggtaggatttgatattggtttttttattatttttgggagattttgtatgagttatgtattttttttatatgatgttatgtatttttttatagggataataaagttagagtatttttgttgtagttgtgtttattgatatgtttaggagtaaatttgtaataaatatggtattttgtgttttgtttaggaggaagtattgttaagaagtttagggatgatttggttgatttttttatttttttttttttttaatttaggtgttatgtggtttattatttgttaggtgtatttatgtgattagtgtgtttttgtgatttatgtgattataatttatgtgattaatttatgtattgataaatgggttagatagtttatatgtttggtattgtgggttttgtggttttttattagtttttagttgtgtttttggatatggaagtagtgtagggtttggttggtatttgtggaggttttttagaaatagtttgtgggttatgggtagttagttttgttttaatttattttgttatttataaagtataagtttatagttattgttgtttttaatttagaagatggttttgttttatgttggttttgtttggtttttatgggttgttttttattttttgtgtgtgtgtgtatgtgtttttttttttttttgtttttgtgtgtttttttttgtttttttgtgtttgtttttttgtttttttgtttttgtgtttgtttttgtgtgtgtgtttttgtgtttgtttgtgtttttttgtgtgtgtttttgttgttgggtgtttttatttttgtttttgtatgtgtttttttgtttttttgttttttttttttgtttttttttttgagatggagttttatttttgttgtttatgttggagtgtaatggtgtgattttagtttattgtaattgtgttttttaggtttaagtgatttttttgttttagttttttgagtagttggaattatagttttgtgttattatgtttggttaattttttgtatttttattagagatggggttttataatgttggttaggttgtttttggatttttgattttaggtgatttatttgttttagttttttagagtggtgggattataggtgtgagttattgagtttagtttgtttgtttgtttttgtgtgagtttgtgtggttgtttttgggagtttttgtgtatgtttttgttttttttgtttttttgttttttttggttttttattgttatggtaaatatagtttttttatattttgtatttggttatttatagaaaatgtatagaagttattttgtaattttttttaagaatgaaaagttgttattatgatgttagtattggtttttaggtgttgttaaaagggattgatttttttttttatttggttttttatgtttgtggtaggtgatgagattattttaataagagtagttaggtgttgtggtttatatttgtaattttagtattttgggaggttgaggtgggtggattatttgaggttaggagtttgagattagttttaatatggagaaattttgtttttattaaaaatataaaattagttgggtggggtggtgtatgtttgtaattttagttatttgggaggttgaggtaggagaattgtttgaatttgggaggtggagtttgtggtgagttgagattgtgttattgtattttagtttgggtaataagagtaaaatttttgttttgaaaaaaaaaaaataagagtattgatatggggaaagttgttatggttttaggtataaaaatatgggtatatggttaatgttttaggttgaaagtttgtatgataaagtttttttttttttttttttttttttttttttttgagatggagttttgtttttgttgtttaggttggagtgtagtggtgtgattttggtttattataatttttgttttttgggtttaagtgagttttttgttttagtttttggagtagttgagattagaggtgtgtgttattatgtttggttaatttttgtatttttagtaaagatgaggttttattatgttagttaggttggttttgaatttttgattttaggtgatttgtttgttttggttttttaaagtgttgggatgataggtgtgagttattgtgtttggtttgataaagttttttttattaatttaaatttggaggttgagtggttttagtattgaatgattttatgaaggtttttatttattttgttgttgagtattgttgttttttgtgagtttttgttaagataagtttttttaaatgtttgagattattgtggtgtttaaggttatagttagttggtagtaatgtaggttgtgggtggtaatagtgtttagtgggatatagtttatattgatgggaagggtggtagagatagtgtgaataaaggaagtggttaggtgatgagaggtagggttgagttaatatttagggttttatatgtatatgaagtttttgtgtagaatttgttaaaaataaagatataaagatagtaggtagaggttgggagtgaaaatatttgggttggattttgttgtatatttaattgaagttttttttttttaaatattttatttatttaaaaattttgattttgtttaagatagtagttttttttttggtggggtggtggggtggatagagttttatttggttgtttaggttggagtgtagtggtgtgattttattatgttggttaggttagttttaaatttttgattttaggtgagttatttgttttggttttttaaagtgttggtatgataggtgtgagttattgtgtttagttaagatggtggtggtgttgtgttgtttatagttgggttggagtgtaatggtgtgattttagtttattgtagttttaaatttaaggaatttttttatttgagttttttgagttgggattataggtgtatgttaaatatgtttggttaattttaaaatattttatagagatggagttttgttgtattgattaggtttgttttgaattgttggtttttagttatttttttgtttttgttttttaaagtgttgggattatatgtgtgagttgttatattgggtttttatttatttattagtaataaatatagaatttttaaagtgttgtgattatggtgtttgattagttttaattatttttgaaaagttttgtgtttaaatagagttatatttggggtagggtttgtatatgatgtttggtgggattaatttagtttgtagtaaggattgttttgtgtattatgtgatgtatagtagtatttttggatttggatgagtttgagtttgtttttattgtaatttgtgataattaaaaaattttttgggatgtggttagatatttttatggggataaaattatttttagttaagaatggttggtttagttatttataattgtaaagatgtggaattaattgaagtgtttattgaataatgagtggattgtgggtggtaaggtatttaggtattgaggtaagagatagaggatatgagttgttttagtataataaaatataaaataagaattgttatattagatatagattttagatatgattatatatgagtattattaattattagttggtagtaattattttttattttaatattataataatttttattttataattatagtttaggaaaaattaggttatatagagataggagttgaggggatatagtgaggtgtgattagaagataagagtgtgagttttttgttatgtttggatagggttattagagggttttttggtttagtggtgatgttagtgtttgggaagatatttgttattaagtggattatggtttagtggtagtaaaaggtgttaattaataatatttgttatttagtagattgggaaaggggtagtgggtgggggggggggtttttttttttttgggggagtttagagaagattttgtttttttattttttgtggagggtttgatattagttaggtttgtttgtagttatttggaggtttaattgtttttttgtgatgttgtgttttggtggttatgtttttagtttgtttttatgttttattttgtatatttggttttgttttttagatagtagtagtaaattagggaaagtattaatagtttttgatatgtagaaataatggtgtaagttgtttttttttttgttttttttttttttttgttttggttgttaggtagggaagggttttttgtttagtggatatgtgatttatgtgattttatttattattggaggtgatttatattttttattttgttttttttgttttgtatttaataaataatagtgtagttagatatttggggttattattggtttttgtgtattggtggtagtggttttttgggtttagttgtttttttttttgtttttttgttttgtgtttttatttttatatttttttgttgttgtatatagggagagatttattgattttgtggggttggtttttatagtggataaagaaaatgtggtgtttatgtattatggaatattatttagttattagaaggaatgaaataatgttatttttagtaatttggatggagttggaggttattattttaataggagtagaatttatatgtttttattttttttttttttttttaagatagttttgtttttgttgtttaggttagagtgtaatggtgtgattttggtttattgtaatttttgttttttgggtttaagtgattttttaattttagtttttttagtagttgggattataggtatgtgttattatatttagttatgtatttttttatttttagtagagatggggttttattatgttggttagattggttttgaatttttggttttaggtgatatatttgttttagtatttttaaagtgatgggattataggtgtgagttattgttattgtgtttggttttgtatgtttttagtgggagttaagttgttggtatataaaggtagagtgatgtaatgggttttagagttttagaagggggagggtagaagggaggttatagataaaaaattatatattaggttagtgtggttgtttatgtttgtaattttattattttgggagatttaggtgggttgattatttgaggttaggagtttgagattattttgattaagatggtgaaattttgtttttatttattaaaagtataaaaaattagttaggtatggtagtgggtgtttgtaatgttagtattttgggaggttaaggtgggagaattgtttgaatttgggaggtggaggttgttgtagtgagttgaggttatgatattgtattttagtttgggtaatagagtgagatttggtttttaaataaataaaataaagggtttagattttattttaaaaaataaatgaataaggttgggtgtggtggtttatatttgtaattttagtattttgagaggttgaggtgggaggattatgaggttagattgagattattttggttaatatggtgaaattttgtttttattaaaaatataaaaaattagttgggttaggtggtgggtgtttgtagttttaggagaatggtgtgattttgggaggtggagtttgtagtgagtagagattgtgttattgtagtttagtttgggtgatagagtaagattttgttttaagaaaaataaatgaataaaaataataagaaagaaaaatagttatgttttatgtaggttgagattggagagtttttgtggatttgtaattttgtttttgtttttgtattgaagggtgtaaggtggttgttttttgtatgagttagtgttttttagttttggtgttgttgttatttggggttgttttgggtattgtaggaagttgagtagtatttttggattttatttattagatgttagtagaatttttttttaagttatgataattaaaaattattatgggtattgttaaatgttttttggagtggagagtaaaattatttagtagagaattgttaggttagagaggtgtaggattttaggttgggtgtgggggtttgtaatttttgtattttgggaggttaaggtgggtggattatatgaggttgggagtttaagattaatttggttaatatggtaaaatttttatttttattaaaaatataaaaattagttaggtgtggtggtatatgtttgtagttttagttttttggggggttgaggtaggagaattgttagattttagtaggtagaggttgtagtgagttaagatggtattattgtattttattttgggtgatagagtaagattgtagtttttttgtttttgtttttgtttttttttgaggagttatagtttgttatttaggttggagtgtagtggtgtaattttgatttattgtaatttttgttttttgggtttgaatgatttttttgttttagttttttgagtagttgggattggttttggtggtggaggtgtttgtaaatttgttggtattgtaattgttagaaaatgagtagtaagaagtgtttgagaaagttagagaagtgagttttttgaggaggaagtggttaatgtgttaaatataattgtgggggagtaataatgagaagggttgaaaagggttattgtatgttttaggaaggaagtttattagtgttggttatatagatagttttagaggaagtgtggggagagaagttagtttttagtgggtggggagtataggtgagaagttagaataaaggttattagtgtgggttatgttttagggagtgtgggttttttggttgggtgtggtggtttagtaattttagtgattttggaggttgaggtaggagaattgtttgaatttggaaagtggaggttgtagtgatttgagattgtagtattgtattttagtttgggtgtgtagagtgagatttaaaaaaaaaaaaaaaaaaaaaaaaatagaatagttgattttttagaagtgagagtaggtggaggttattaggggttgggggtggtaggagaggaagatgttggttaaaaagtataagtagttgggtgtggtggtttatgtttgtaattttagtattttgggaggttaaggtgggtggattatttgagattaggagtttgagattaatatggagaaattttgtttttattaaaaatataaaaattagttgggtgtggtggtatgtatttgtagttttagttatttgggaggttgaggtaggagaattgtttgaatttgggaggtggaggttgtagagttaagattgtgttattgtattttagtttgggtgatagagtaggattttgttttaaaaaaaaaaaaaaaaaaaaagtataatatttagttataagatgagttagttttgggggtttgatatatgggatggtgattatggttaatataagtagtttttaaatgtttttatttttgttttttgttattagttaaagttgtgaagttttaggtttttggtgttttgaataaagaattgggtgtgatatatatatatagtaaagtggtataagtttattaagtataggattatatttttggagaggggagagtaggtggatttttgtgaaatgagattggtattagtttgttgtattttgggttttttttttttttttttttattaggaatatataattatttatttattgtttattagtatttataataaagtgaataaaatatagtttaataatatttagattattataaagttgtgttttttggtttttattgaattagtaaagtagatattgaaaagattgagtttatgtggtttttttttttttttttttgagatggagttttgttttgttgtttaggttggagtgtagtggtatgattttggtttattgtaatttttgttttttaggtttaagtgatttttttgttttagttttttgagtagttaggattataggtgtttatatgtaaggaatgagttggggtaaagaaaaaatatgtgagttagtagtttatttattttgagagggagttttgttttgttattaggttggagtgtagtggtgtaattttggtttattataatttttgttttttgggtttaagtgattttgttgttttagttttttgagtagttgagattatgggtgtaagttattgtgtttggttaatattttgtattttttagtagagatggggttttattgtgttggttaggttgttatttaatggaaaaattagatttagagaataaatttgattggtatgaggtattagaataatgggagggtgtgaggatttatgtgatgagtatataaatgggttgataagtagaagtttttagggaggaaagtgatggtggtgtttagatagtattttaagatttttagtgagaagttttaagttgtaggttgtgttatagttttgtatatatatttatttatttgatatatattttttgagaattttgttatagttgtgggagttgtgaatgtagttattaaatttgatatagattaatttatatgagtttatggtagaggtaggaaaatggatatgtatgttgaattagggtttaagtgttgttatagggaattaataggtgttttgggatgaggaaagtgttgttttggttgggtgtagtggtttatgtttgtaattttagtattttgagaggttaaggtggggggattatttgaatttaggagtttgagattatttagggtaatatgatgaaattttatttttattaaagatgtaaaaaaaattaattgggtgtggtggtgtgtgtttttagttttagttatttgggaggttgaggaaggagaattgtttgagttttagaggtgaaggttgtagtgagttgagattgtgttattgtatgttagtttgggttatagagtgagattgttttaaaaaaaaaaaaaaaagtgttatttttgtgaagttggagttgtggaaatttttggaggaaatgatatttttgtagagttttgaagaataaggtaaggtgtggataaagaagtaaagatggtggttgggtatggtgatttatatttgtaattttagtattttgggaggttgaggttggtggattatttgaggttaggagtttaagattagtttggttaatattgtgaaattttatttttattaaaaatataaaaattagttgggtgtggtggtgtatgtttataattttagttatttaggaggttgaggtaggagaattatttgaattttggaggtggaggtggtagtgagttaagattgtattattgtattttagtttgggtgataaaagtgaaatttgggggaagggatagtattaggagatatatttaatgttaaatgatgagttagtgggtgtagtatattaatatggtatatgtatatatatgtaattaatttgtatgttgtgtatatgtattttaaaatttatattaaaaaaaaaaaaagtgaaattttgttttaataaaataaataaaaaaaaagaaaaaaaaaaaaaaggaagagaagatggaataattttgtggttagaaggaattggggtatggttgggatgtagttaggagttatttattttttttttttttttttttttttgagatagaattttgttttgttatgtaggttggagtgtagtggtgtgattttggttttttgtagtttttgttttttgggtttaagttatttttttgttttagttttttgagtagttgggattataagtatatgttattatatttggttaatttttatatttttagtagagatgtggttttattatgttggttaggttgtttttgaatttttgattttaggtgatttttttattttggttttttaaagtgttgggattataggtatgagttattgtgtttggttgagtttttgtatttttagtagagatggggttttattatgttggttaggttggttttgaatttttgattttaggtgatttgtttgttttagttttttaaagtgttgggattataggtgtgagttattgtgtttggtaggatttatttataaagttgtttttttataattggttgttgttataatgttttttgaattatttgatatagatttattttatattggttattaattattttgaatggttttttgtagagaaaggaaagaaaaaaagattaaagtaggaaaaaaatatttttatggttattttgttaaagaaggagagatttttttagaaaagattagagtggttaaaagtatggtttgtagtaagtggtataaaaatagttagagtttagaagagattataggatttgtttatagaagaaatttagtggttgggtgtagtggtttatgtttgtaattttagttttttgggaggttaaggtggggagattatttgaggttaggagtttgagattagttaatagggagaaattttgtttttattaaaaatataaaattagttggggtggtggtatatgtttgtaattttagttatttaggaggttgaggtaggagaattatttgaatttgagggatggagagttagaggttgtagtgagttaagattgtgttattgtattttagtttgggtaataagagaaaattttgttttaaaaaaaaaaaaaaagaaatttagtatgtagtttttttattttttgtattgtttgggatgttttgataaatggaatgttagtgtttttttttttttgtagtgatttttttttttgtgggtttaatatagagtttatgttgtttaggtttaatattagtttttagatttatttatggttattgtgttttatggttattttttaaagagtttgtgtgtttagtttttttttgtttttttaagtggaagttttgttggtttgttttttagttttttttttgttgagttagtttttaattaggaattatattagagttattaggattagaaaggttaggtttatttgaaggagattttgggtagtgtgattttagagggtatggtttgtaggtaggagaatagggtgattgttgatagggatgtaaggatattttttttttttttttttttttttttttttttttttttttttttgagatagagttttagttttgttgtttaggttggagtgtaatggtatgattttggtttattgtaatttttattttttgggtttaagttatttttttgttttagttttttaagtagttgggattataggtatatgttattatgtttggttaatttttttgtatttttagtagagatgggattttgttatgttggttagattggttttgaatttttgattttagatgatttgtttgttttggttttttaaagggttgagattataggtgtgagttattgtgtttggttaaggatatttttttgtttttatttagattttttttttaggtttattttatgtttagtttttttttttagagtttatggttttagttgtttatttatttttttggagttttgtttttgtggttaaaaggtaggtgttttaagtgtttgttgatgataagggaagtgaagaaaagaggatggttttgattttttttattttagtatttttttttttgggtttattttatgatgttttgtagttttataaggttttattttattttgtgggttttaggagttttatttagtaggtaaagtggaagggtttatagatggatgaatttgatgaggaattttattttagtatttgtgagtatgtgtttttgtattagttatgttttttattttttttttttttgagatagagttttattgtgttttagtttttggagtagttgggattataggtatatattatatatttaggtaattttttttatatttttagtagaaatggggttttgttatgttggttaggttggttttgaatttttaattttagatgatttgtttgttttggttttttaaagggttgggatgataggtttttgaggttggagtatagtggtgtgattttagtttattgtaatttttgttttttgagtttaagtaatttttttgttttagttttgagtagttgtaattattggtgtgtgttattatatttaatttatgtttgtatttttagtagagatggggttttattgtgttggttaggttggttttgaatttttgattttaagtgatttagttgtttttgttttttaaagtgttgggattatatgtgggagttatttggtttagtttgttttttatttaagttttattttttttattaagttattattatttttttttttttatatatatatatatagtgaaatttaaagttttattatttttttttttttttttttttttttttttttttttttgagatggagttttattttgttgtttaggttggagtgtagtggtgtgattttagtttattgtaagttttgttttttgggtttatgttatttttttgttttagttttttgtgtagttgggattataggtgtttgttattatgtttggataatttttgtatttttttttagtagagatagggttttattgtgttagttaggatggttttgattttttgattttatgatttatttgttttggttttttaaagtgttgggattataggtgtgagttattgtgttgggttttatttttgtaattttagttgtgtgttttaggtttattttattgttattttttaaatattatttttaatttttttggttttatagttattattgtattattttagttatttttttgttttagggtataggtagatgttattttattttttttagagtttttttttttttgatagttatatgattaatttaagtttgaatgtatttgtttagatgttttttttttttgtgaggtttatttggataaatttatttaatattgttagttgttattttaattattgtaagtttgttttattttgttttttttttttatagtattatttttttttgtgtgttattttgatgttgattgatggtgtgtttttttttgttagaatttaagtgttgtagagttaagatatttgtttggttgattgttatagtgtagtttattgtgtatattatgtatttgatgaatatatatatataatagttttgtttttgtttttttgtgagatggagttttgttgtgttgtgtagtggagtggaatgtagtggtgtgattttagtttattgtaatttttgtattttaggtttaataatttttttgttttagttttttgagtagttgggattataggtgagtattattaggtttggttaatttttgtatttttagtagagatggggttttattatgttggttaggttggttttgaatttttgattttgtgatttaattattttggttttttgaagtgttgggattataggtgtgagttatgatgtttagtttaagttttgtatttttagtagagatagggttttgttatgttggttaggttggttttaaatttttgattttaaatgatgtattattttggttttttaaagtgttgggattataggtgtgagttattatgtttggttttgatgaatattttgaatgaatgttatgtttttagtgttattgggaggttttgattgtttgtttgagtttagaaggattagttatttattaggaaaggtggggtttttaggtgtaaggttggtgtttttaatgttgtttggaaaaggagataaagaaaaaaaagtaagggtttttggttttttttggttttgttattttttttttttttttttttttttttgagatggagttttgttttgttgtttaggttgtagtgtggtggtatgattttggtttattataatttttgttttttgggtttaagtgatttttttgttttagttttttgagtagttgggattataggtgtttgttattgtgtttggttaatttttgtatttttagtagagatggggttttattgttttggttaggttggttttgaatttttgattttgtgatttatttgttttattatttttttttttgttttttttttttttttgtttttggtgtttttttttatatgattaattaggtatttaggaagtggatgttttttggatattttttttattattttttggggattttttagggttttaggtaggatatggtggtgaagggtgtggggaattgagtatttttttatttgtgattaggagttttattggtttattggggaaagattaggtatggttgttataggagttaaaatattggtatgttttttggtgggttgtggttatagggtttagggggaattttgtttggatttttttgtatttgtgttgtatgtggttggattttttttttttgagtagtaagaatatgtttgttgtagtgtttagatggtagtagaaggttatttttttttttgagattattttgggtttaggatgaattgagagggtgggtgtgttatatatttttatgagagaaggtggggttattatattagaaatttagtgatgagtagttagttatttttttttttttttttttagagatggagtttttttttgttgtttaggttggagtgtagtgatatgattttggtttattgtaatttttgttttttgggtttaagtgttttttttgttttatttttttaagtagttgggattataggggtttgttattatgtttggtagttagttttttttttttttttaattattattttggttaaatatatataatagaagatttattgtttaaaattatttttaaaaatgatatagggttttgttttgttttttaggttggagtgttgtggtattatttttgtttattgaagatttgattttttgggttaggagtttgagattagtttggttaatatggtgaaattttgtttttattaaaaatgtaaaaattagttgggtgtggtggtatatgtttgtaattttaattatttgggaggttgaggtaggagaattgaggttgaggtagaggttgtagtgagttgagattgtattattgtattgtagtgagattgttttaaaaaaaaaaaaaaaaagttttggttagttgttttgtttgggaggttggggggtagtttttgtttggttattgttttgtttgggaggtgggggggtgtttttgtttggttgttttgtttgggaagtgaggagtttttttgtttggttgttattttgtttgggaggtgtatttaatagtttattgagaatgggttatgatgatgatggtggttttgttgaatagaaaaaggggaaatgtggggaaaagaaagagagattagattgttattgtgtttgtgtagaaagaagtagatataggagattttattttgttttgtattaagataaatttttttgttttgggatgttgttaatttatgattttatttttaattttgtgttttttgaaatatgtgttatgtttatttagggttaaatggattaagggtggtgtaagatgtgttttgttaaatagatgtttgaaggtagtatgttttttaagagttattattattttttaattttaagtatttagggatataaatattgtggaaggttgtagggatttttgtttaggaaagttagagatttttgtttatatgtttatttgttgattttttttttattattgttttatgattttgttaaatttttttttttgagaaatatttaagaatgattaataaatattaaaaaaattaaaaaaaaaagaataaatgagtagttgtgtttttttgttagaatttttaaataaggtttaaagattttgagtaaatgaaaaggtatagataaaaaatatatatattttaatataagtatatgatatagaatatagaaataattttttttaattaattaaaatataagtaatttaatttaaaaataggtaaaagatttaaatagatattttataaaagaagatatttgaatggatatgaaatattgttgtgagttgtataatgatattttggttaataatgtattatatatatgatggtggttttataagattataatgaaattgaaaaatttttattgtttgatgatattatagtttttttagtataaagtattgtttatgtgtttttggtgttgttggtataaataaatttaattgtatagtatatataattatgtatgtatatgtaattatgtataatatttgataataataataaataattatattgttaaaaaaaaaaaaagttaatttttttttttttttttagaaaattattatttggttgggtgtgatggtttatatttgtaattttagtattttgggagggtgaggtgggtggattatttgaggttaggagtttgatattattttggttaatatggtgaaattttatttttattaaaaatataaaatgtggtgtagtggtgggtgtttgtgattttagttatttgggaagttgaggttggagaattatttgaatttaggaggtggaggttgtagtgattggagattgtattattgtattttagtttgggtgataagagtgaaattttgttttaaaatagataaaaaaaaaaaaaatttattatttgtgatgggtgagggaagtaaagtgtaagttattgtgtttagtttataggtattgtttttgaggatattttttagttatatttttgtatataaatatttattttagaatttgtgttatggagaaattgattgaggatatatttgtttttaggatgtagagatatggtttgtagataattttttgtaggtaaggattgtgatggggattatttttttttttagttttttattgagataagtagtgtttgagtggggtttggaagagtttatagatgatgttgtattttggatgtagattgagattattttttagttagagaattggatagttatttgttattattagatttagtaagttgttgggttttgattagagttttttaatttgatagatgtagttgtattgttttgttatgtgggagtttatgtttgggatgtagaatttgattttgttaatttgtttagggggttttggtttgtttatggtaaaaaggttttttttaaagtgtagttggtatttaatagttttataatttttttggtaatagatggttatttgttttttttttggaattatgaaatggggtttggtttagatgaatggttttgggagagtttttggaagggaattagaggttggagttttagtggagttttttttttttaattttaggttttatttagttgttggttttaagtttttttgggaagttagtattttgttttttttttttagttgtgtttgggtggaaggagtttggtttgaatttggaagagtgattttgggttttgaaggaaggatttatgttgttgggtgttgattttttgatttagatatagttttggaagatgggagtaatgagatttgttgttttttaggtatattgtgattttattttttttttatgttagaatttattgatgtagagtagggtagggagtgtggaagatattgtttagattttgttggtttagtgttgagtagtggggattgagttgggtgggttagggagatagatatataggaagtggtgggtgagtattagtgtttattattagagtgtttttatgttgattgtttttattagaatgtttataatttttttttgtttttgattatgagtttatagaaaggttgtggtttttttgatatatttgtggtttagttagtaattttgataattgtttgtttagtttaaaatgtatttttgggttaattttttaattttgtaatgtggaggttgtatttagagttgattgtgggaagttgtgtttaattatgtttagaggaaattttttgagaattgtataaaaatatagggagttttatagtgagatattggaataggaattaaaagaaattatagaatgtgtaaataaaaatttagttgtatttaagaaaatttagttttttttgaggaagagaaagaggtggagttttttaaatatgaattgtttgtttttttgtttgtggttagtgagttttattttttttttttttaggtattgtgaagattttgttttttttgttgtgtggttgtaagattattagataggataattttaagttgtaaaatatattttttttgaaaagtaaggaataatgtgatgtatgttttaattgaataattgtttttgttttttgtttttgtaatatgtttttttttgtatagattttttttaattttataaaatgtttaaaaggtaattggattttttgtttgagttttagtttttttggatgttaatttgattggggttggtgtatttaaataataataataataataaattttttttaattttttggtttttttgatttttaaattattttttaataatattattttatattagttagaatggttattattgaaaagttagaaattaatagatgttggtgagattgtggagtaaaggggatatttatatattgttggtgggtgtaaattagtttagttattgtggaaagtagtttggtttggagatattttagagaattataaatagagttattatttagtttagtaattttattgttgggtatatagttaaaggaaaataaattattttattaaaaagatatatgtatttgtatgtttattgtagtaggatttataatagtgaagatatggaatttatttaggttttattagaggtggattggataaagataatgtgatatgtatatattatagaatgttatatagttttgaaaaattataagattatgttttttgtagtaatatggatgtagttagaggttattattttaagtgagttaatatagaaatagaaaattaaatattggttagatatggtggtttatgtttgttattttagtattttgggaggttgaggtaggtggattattttaggttgggagtttgagattagtttgattaatatgtagaaattttgtttttattaaaaatttaaaattagttgggtgtggtggtatatgtttgtagttttaattatttgggaggttgaggtaggagaattgtttgaatttggaaggtgaaggttgtagtgagttgagatggtgttattgtattttagtttgggtaataagagtgaaattttattttaaaaaaaaaaaaaaaaaagaaaagaaaattaaatattatatgtttttatttataagtgagagtgttaaatattgggtaaggaggggagtaaggtttgaaaatttatttatttggtgattagattattaatgtaagttttagtattatgtaatatatttataaaaaatttgtatatgtatttgttgaatttaaaaagataaaaataggggttttgatgttggtttttttgtgtatagtatatatatgtttggataagttaattggttttattagaatggaatgataatattaatttttttaaagatagtgttataatgttttaataaaataaaagtgaaaagaaaagttttttatttaaagaatttaataagaaaagaaatatttttttttttttttttttttttttttttttttttttttttgagatagagttttgttttgttgtttaggttgtggtgtagtggtgtgattttagtttattgtaatttttgttttgtgggtttaagtaatttttttgttttagttatttgagtagttgggattatagatatttaatattatgtttagtttatttttgtatttttagtagagattggtttttattatgttggttaggatggtttttaattttttattttaagtgaatttttttgttttggttttttaaagtgttgggattataggtgtgagttattatatttagttaagaaatattttttttaagtaagtaattaattttttatttaataaaaaaaaattttatgtagaagttgttaagatttatagtaagaaaaaagaaatttatgtattttatatatatatatatatatatatatatattttttatatatatatatatatatatatttatatatatatgtatatatatatatatatatgtgtatatatattgtatagtattgtatatgtatatatatatatgtatatatatatatatatgtatatgtgtatatatatatatatatgtatatatatatatatgtatatatgtatatatatgtatatatatatgtatgtgtgtatatatatatatatgtatatatatatatgtatgtgtgtatatatatatatatgtatatatatatatatatgtgtgtatatatatatgtatgtgtgtatatatatatatatatatatgtatatatatatatgtatatatatatgtatgtatatatgtatatatgtatatatatatatgtatatatatatgtatgtatatatatatgtatatgtgtatatatgtatatatatatatatatatatgtaaggtattatgtagtttttagtatttattggggttttggaatatattttggtggatatatgtgattattgtataagattagttgtatttttttgaggtaaataaatgtgttaatttttttttttttttttttaagatggaattttattttgttttttaagttggggtgtagtggtgtaattttagtttattgtaatttttattttttgggtttaagtaatttttttgttttagttttttaagtagttgggattataggtgtgtgttattatatttgattaatttttgtatttttagtagagatagggtttttttatgttggttaggttagttttgaatttttgattttaagtgattagtttattttagttttttaaagtgttgggattataggtgtgagttattatatttagtttgttttttttttatttattgaagatttagtatttggtgttggtgtttttttttatatagttgttataattttgggtgttttttttatttttttttttatggagtgtttggatgttttttatggaggagatttatgtaggttggatttttagattttagttatttttttagttataatatagttatttttattaaagaaatataagaatattgttttttattattttgagtttttaattttgatataattttagatttgtaaaaatagtttaaagaatttttggttaggtgtagtggtttatatttgtaattttagtattttgggaggttgaggtgggtggattgtttgagatgagtttgggggaaaaaaaaatgtaaaaattagttaggtgtggtgttgtgtgtttatagttttagttatttgggaggttgaggtgagagggttatttgagtttagggaggtagaagttgtagtgagttatgattgtgttattgtattttagtttgggtgatagagtgttattttgtttataaaaaaaaaaaaaatttgtaatttttttatttagatttttttaaagttagtattttattatatttgttttattatttagtttttttttttttttttttttttttgaagaaagtgtgtttaatttgtatatgatgttttaaatttttaattattttaggttatattttttaaaattaaggatattttgttattaatgtttaaggttaagaaatagtattgatatgatattattgtttgatttatttattttatttaaattttattatttgttttattagtgatatatatttggtttaggatttaatttaagattatataatttatttaattgttatgttttttttatttggagatggaattttgttttgtagtttaggttggagtgtaatggtgtgattttagtttattgtaatttttgttttttgggtttaagtaatttttttgttttagttttttgagtagttgggattagaggtatttataattatgtttagttaatttttgtatttttagtagagatggggttttgttaagttggttaggttggttttgaatttttgaatttaattgatttatttgttttagttttttaaagtgttgggattagaggtatgagttattatgtttagttttttttaaaaaataaaattatagattttattttgattttattagtttttttattagtattttttttttgttttaggagttttagtgatttgtttgttttagttttttatttgttttggttttttaaggtattgggattataggtgtgagttatttggatttatttaatttagttttaagtttatattagtatttttgggattgttttttttttatagattttaagttatgtttgagatgatgaattttaagttgtgatttaattatttaagtggtaagtgatatagaggatattattaatttttttttttttttttttgagatggatttttgttttgttatttatgttggagtgtagtggtgtaattttggtttgttgtaagttttgtttttggggtttatgttatttttttgttttagttttttgagtggtgtaattttgatttattgtaagttttgttttttgagtttatgttatttttttgttttagttttttgagtagttaggattataggtgtttattattatgtttgggtaatttttttttttttttttttttttttaaagtagagatggggttttattatgttagttaggatggtttttattttttgattttgtgatttgttttttttggttttttaaagtgttgggattataggtgtgagttattgtatttggtttttttttggtatttaaaaatataattttattgagatataatttatatgttatataattatttattaaaagtgtataatttaatggtttaaattttgtggtatttatggagttggtgtaattgttaatatagtttaattttagaatgttgttattattgttttttagaattttatgttgattagttgtttattattatgatttttttatttttttggttttaggtaattatttattttttgtttttaaatattagaaggtattttttaaaaattgtggtaaaatatatataatatatattttaatatttaagaagttttttaaggttaggtgtagtgggttatgtttgtaattttagtattttgggaggttgaggtgtgtggattattaggttaggtgatttagattgttaggtttttgagtttaagttaagttattatatttttttgtggtttgtatgtatatatttagatggttggtttttgttttaattgatgatattttattatgaaagaaatgaaaatggtttgtttttgttttaagtgatgatattattttatgaaatttttttttttggtttattttggtttaaaagtttttttattgagtattttgtgaattttatttttgtttgttagagaataatttttttttgattgtaatttttttttatttatttaaattttataaaatggttgtatttttatttttttttgttgattttttttttggatttagtttgtttgtatttaggtgaaataaatagttttgttgtttatataaattttgtttggtggtttttttatatggatgtgagtgaaatttggtgttataatttgaattaggggattttttttaggagattaattttttgtttttttgttttttgttttatgagaaagatttatttatgattttttgtttttagattaattagtttaaggaatattttattaattttaaatttagtaagtagtttttttttatttttttttttaattttttttattattttttaattatttttttttttttattttttaatttttttttttttttaattttagtttttttttttttttggtagagataggagatgtgttttatttgtggatttaaaattttagtgttggttatggatttgggaaggtagtttttttttggtgtttaattatgtagggatatttttttgattatttatttatgttttagaggtgtttgattatatggggatgtttgttttggttttttatttttagtggtaagtattgtttttttgggggggtaagaatttttaattttttttttgtgtttttattttttttttgtttttttgggggggtaagaattttttaatttttttttttttatttttagtggtaagtattgtttttttagggggtaagaattttttgattttttatttttgtgttttgatgttttatttttgtattttgattttttatttttatattttgattttttgtttttgtattttaattttttatttttgtgttttgattttttttttgtttttttggaaggtaagaatttttgaattttttttttttatgtttttatttttttttttttttgtgtttgttttttttagtatgggtaattttttattttttatttttttttttttttttttagtttgtgtttttaaaaatttaaaatttttttaatttatatttgatttaaaatttaaatgttttatttttttttgtaatgttgtttgattttaatataaatttgatagtggttttaaatagttagaaaatggtatttttaatttttttattttataagatttaaataatttttgttgtaaaatgggtaaatggtttgaggtgtttgatatttaggtatttttttatatattggtttttttttagtttttatgtttagtgtaatttgttttaaatttttttttttttttttttgtttgttttgttagttttaattttaagtattgttgagtttttttaattttttttttttatagatttatttgatattttttttttttgttaggttgagttgggttttaatttttttttagtttttgtttttttattttataatttttttattattttttttttttatatttggtttagtttatagttttattttatgattagtttttttttaattgtttagtaatttttttttaaaaaggtggttgaagttaaaggtatagttaaggttaatgtttttttttttttatttgattttttttaaattagatagtgtttaggtttttttttattaaatttaaaaatatagtttagtttatggtttatttggtagtaattttgagatgttttatagttttagattttaagttaaaaggttgttttatttttaatatatattttattattaaatttgtttttaatattaaataaagttttaaaaattaaattttgttttttaaattttataataagatttaattaattttgtttttaaggtgtatagtaatagagtagaggtagttaaatagtaatatatttttgagttgtaattttttgtttttattttagtatttagatgagataaattttagttatatttttagtatatgagaattttaaatgtttgaattgtagttgttaggggtttttttagaatttttttttttaggagtttgttataagtattggaaatttggttattgggttaaggaatgtttatagtttgggattttttttaagttgtattttatttgtgtgggattttattgaaaattggattgtttaatttatttggtagttatttttagagtagttagaattttggtttaaggttttttgatttttttttagatttttttggtttagtagttgaagattgatattgtttgattttgattgttttagaagtttataggattattatagtttaggtaatttttatagtggaaggtaagtttgttttttttttaattaatatggaggttatttattttatattattttttttttaagggtttgttttttttgtttttataattgttgtaggtattgatagttaggtttttaaattttttaaaattttttaattttggtgttaatttagataatatttttttaagtatttttttttagttatttttatttgtttagtttttttattaggttgagatattttaattaaattatttgtttttttgattgtttttggattatagttatattttattgttgttattttttttaatttaaagttttttttgttttttttttttgtatttttttattttaatttataagtataggatatttttattttttttttggtgattgattatgtattttttattattttattaaaatttaattatttttattttatttaatgttaatattttattttgtagtatgttttaaaaggattaaagtttgttatagtatggttttttaaagtttataaattttttttataatttttttattttatttgttttaaaattagataaggtttatatattagtttaggatttgtgttttattaattaaattgttttgtttatttattttgtagtgttaaatttatatatttttttatttttaatatttgtttttataatttattattttgttttggattttaaatgtgttttttttattatttttttgtattttttattttagtttttttttgtttttatttggattgattttgatattgattaagtttagtaaattatttgggttgtattgttgtaaagttttatagatagtttttattattttagttaagtttaaattttttttttttttgttatttattttggtataatttttataaaaatatatgtgttttttatgttgattgtgtttgattgattttttaagttttagtattttttataaaataataattttttttttttttaggtatggttagtgtggttggaatttttatataagagttaggattgtattttgtagtttttttgtttgaataatttgattttattgttttagtttagtttttatgtttgtgagtagtggttgttgttgttttaatagttttagaggtttttaaaattataaattatgtttaatttattttttatagtttttataatttttaaaaatttatttttttttttatatttgatgtatatattttttgttttttggtttttttagttatatttattttttgttgagttttttataattattattgttattggtttatattttaatttggttttttatattattttggatattatatttgatttttatgattgtatttttttgatttatttgatatttattttatttttttatattttttttttttttattttttattttaattatatttagtttattgatggtagttttattaggtttaattgttatttattagtaaaggtaggttatgttatagtattttttatatttattattgaggttattgttttgttttttttattattttttagtaagttgaattagttgttttaatttaagtttttattgatgtaaaaggattatgtattaatatttatattgattttaaatatgttttttatattttgttttattatgtggttatatgggttgaaagaggtttttttattatataagggttttttatttttaatgtttttttaataaaaattttgtttaaggttgttttatttttaaaggaagttggagttatttattgtaaaggttattaaaagttattagattttattgttttagataatgtttatgttgataaggtggttagataagtagttagttttttaatttttgttttttatatttatgtttatgttgataaggtagttagataagtagttagtatgttaatttttgttttttatagttagttttttttttttttattagttatttttatttatttttttattgaaatttttatttattaatttttttttatataaggtaaatggtttttagattaaggaaaatatttttttttagttttataggtttattttatttgg

SEQ ID NO: 73 - DNA, 25681 bp, Artificial Sequence
  chemically treated genomic DNA (Homo sapiens)
tatgtatagatagatgtatatatatatatgtatatatatagatagatgtatatgtatagttgaaggatgtataggttttttttggaagttataagtaatagtgatattttttagggaggggaattaaggaatgggaggatagtggtatggtagaaaggagattttttttgatttgtgtaattgtgtaagaaaataaatgtaatttttaaaagaaatatttttaattttattttataggtggtaggtgatatagtatgatatatagtaatgaaattttgttttatgaagtaggaaatgaagagtgtagttttgttttgttattaagtagtagtgtgattttggaaaagttttttatttattggaggttttaatatttttttatttataattgaatagtattaaattgaattagtttttttggtggtttttggttttgaaattttttgatttttttagttagtatttgtaaggtttggagtttttgtgaggttgtagtttaatgtaaatgtgtatttgaatttgtatatatatatatatatgtttttttagaaggtaatagagtatagagttttaatttaggaaaagaggaatgttaaatttatggttgataatattttgagaatttattgttttttgaattagaaaaataaaatataaaaagttttttagtaaaaattttggttgtattagaagaattgtattgtattttattagaaatatatttttggggttgatgtgtatagtttatagaaatgtagttttgaaaatatatattatttatattttttaggagttttgaaaaatagaaagttttagtgtgttgagtaaaagtatttaaagtatttatattggtttttattaatttaagtggtagttttttttttttttttttgataagattttaaatgtttattagtaagtagggaatatgaagataattaataattatttaatttttagttttttgggtatttgatagtaaattttataaatagtatattattaaaatatttttttaagttagtggttgagatttgttattatttttttttaaataattgttatgtttataggtggtttttttatagttattatgatgtttgtatggtattgggtgaagttagttttattttagaattattaaatgtttttaggaggatttttaaaaagtttgttttttttttaattatttgtatgatttttgttttatttatgtgttattaaaaagtatttatttaatatttttagtatttaaatttatttatttattttttttttattttaaaaggaaattttatattattattgtagatggaaaattaatgttatttttataaatagaaggtagggtaaaaatataataaaaataaaatttattaaatttaagtaagatatagtggttgggtaaaggttttgagtttgaggttttatatagttttgtttttgttaatgtttttgtggtataatttatatatatagatgttagtgttttgagtatagagtttgatgagttttgttaaatgttatatatttttgttattattaatataattaaaatatggaatatttttaagattttagaaagttaagatttaggaatagggaaagggaggagttagtgttagaaagaaaggtgttaatggtatagtagtattttattgaagtgttattttttttttgtttgtttgttttttgttttttgagatagagttttgttttgttgttaggttggagtatagtggtgtgattttgatttattgtaatttttgttttttgggtttaagtgatttttttgttttagttttttgagtagttgggattataggtgattattattatgtttggttaatttttttgtgtttttagtagagatagggttttattatgttggttaggttagttttgaatttttgattttaagtgatttgtttattttggtttgttaaagtgttgggattataggtattagttattatgtttggtttgaaattttattttttttgattagtttaaagagaaaatagtgttgaaaaatagtttttagtatatataatgtttttattggtggattatttaaaatttattttatttattatgggaggtatttggtttgtatatgaagtattagtattaaagggaggaagaagatagaagtagggatgggggatttagaggttgttgtttaagggtttttgtatttttatgttatgtatatgttgttttttttatttagaatttttttttatattttttgattttatattttttaataagttattatttatttattatgatttgatttgagttatttttttttggaggttttttttgtttttttaggttggattaggtagtttttttatatttttaggttttatagagttttatattgaagtttatttatggatttatttgtttgtttattttttagattttgaggtttttagaggtagataggagttttatattaataattattatgaagatgattataatgtagaaaaagtagttaaaatatattgagaatttatatgttaggtattgttataagtatattatatgtagtaaattatttgatttttatagttatttatttattggatgttaatagtagttgttttgtttttttttttgttgtggtaattaaaaatgtttttaggtattgttaaatattttttgttaggtaggtttgtttttagttgagaattatggtttttggttttagagttttagtatggtataggaggtttgtgtatagtagaggtttaaagattgttggaagtattaatttatgatttatgtttttaatttgaattgatttagaaatgagatatttttttatttttagttttggtaggtgatgtttatttttgtggtagatatttgaaagtttttatttttattatttttttttttattaagtttttgggtgtttatttaataggtaggttttgtgaatatgtggagaaatttttggttatttttaaaaattataggataagattgttggggaggttagtttagtttttttttttgttttattaagtaagagttttatgttgagatttaggttttagttaatagagggtagtatggggttaggggattttagatttatttttatttttggttgtgagatttggggaaattttatgtttttatgtgtgatatggggtgatgatattggtgatgatataagtttgttggtttttttaatttatgtaaagtttaagatatatagaattaatatttagtaaatggggtttattggattattattgaaagaataatttttttggtgataattttgttttttttttgttatagttagtttattttataataatttgaatgtattagtttttaatttttttgaaagtattatgaaaaaaaggaagatatttttataaaaataaaatgggttggttagtattttaggaattttttttttattttagattttgttgatttttagaaaatgtgtggaggaggtaaaatgtgtttttaatattttttttattttatattttgtatttttttttttaggttatttggtagtggattgattaaattttattaaagtgttagtgggttagtgagttgtttgttataattaaaatattagtatatttatattatttattttatattgagaattgtatgtatttagtgtatgtttatatttgttttataagaattttatgaagtagttgatattgtttttttattttatatagggggaaaatgaggtttagagagggtgagtaatttgtttaaggttatatagtttttaagtagtagagttaagatttatttttaggtaatttggtttttttatttttttaattattattttattttgtattttaggaaagaggtgattttttggatggtgatattttgattttgatatagggaagtaaggattttttttggaaaagaaattattttgggggttttattattttatttgggaggtgggttgtttttgataattgaagatatagatttttttttttgggaatgtttatagtttttttttttgttttaggattgagttaaagattattttaaaaatttatttaggttatatagtggtttttgttagtgtttttttttttggaagttttgtgagtttgttgtttatttttgtagatggatatatagttaagtttgaggtggttgtttgtttagtgttaatttgttagttaatagattatttttgaaaaaaggaatagtaagagaatattttttttgtttagaattgtaggtgggtggaatttttgggaagtagaattgtatgattaaaatagaaatttagttagggaatttttgagaggtagttgtttttggggggtatagggaggggtagaggtaaatggagtttttaggtttgagtggttgggaagagagaagtagggtttggtttgggggttggatgtttttttgatgggtagtagggttatagggttttattgatttttggttaagttgatttgatttatggtttgatgagtttattttgatgttgaggtggtgtgagttttagggtttgggtttgggatatgatagtttgttgttaaggtagtatttaggatgttatagttggtattgtagatttgtagttggaggaaaggggagtagatagagaggtaaattttgttttttgttatttgttttgataatttttataattttttgtttattaggggttataaagaattttaaaatagagtaggaaggtggatagattttttatttggtaggtgtgtataatttagagaaagaatttttttgaaaagtaatgggttgtttttaaataataaatttgatatttagtaaattttttgataagtttttagattattgttgtttatgttttatttagttatatatatatattatttaatagtaagtagatttttaattaatgaattatgtgtattaatgattagagttaggttgttatattttttgtttggaggtgatatatatagatataggtttgaaagttgagaaattttatttggataaattaggtttagaaatgttaaaaaggaaagggaggatatttgttattttgttttgtttatggaattattggaaaaagttattttgaaggtgatgtttttgttgattttgttttagttaagatagttgtttgttttttttagatggggttgaaagaaggatttagtggtgttttttaggtaggttgttgtaaggttaggtgtttaggatataggattgaggtgatttataagtaatgaggtttgtagattggttttggtatgattgtttgtaaaaatatatgaatttatgtgttgatatgtattgtttttggataggggtggagaaatgtatggaatttgtaatttgtaggttttaaggttattttttagatgggggtagtagggtttaggtatgtggtatatataaggatttatttttatttttaaatttggatgggaagaattgttttttgttggttttaagttattttttggggtttttttgttttggagaattttagagatatttttatttttagttattttaatagtttatgtttattgtgttgtaagtttttatgtgtatgtttttttgttttttttgtagtttatataaatttttggagatagttattttgaatatttttgtgttagagatggggaaattgaggtttggggtgtagggaaatttttaagattataaaaagttagggtaaagtttgtatttaattttagggtgggggttgtagtgggggttagggggaggggtagtgtatagggggaagggttgtatatgtgtagtatgtatgtgtgtttatataagatttgtagattttattagttttgtttgtttttgagatagagttttatttttgtagtataggttatagtgtagtggtgtaattttagtttattgtaatttttgtttttagggtttaagtaatttttttgttttagtttttttagtagttggaattataggtgtttgttattatgtttagttaatttttgtatttttagtagagataggattttattatgttgtttaggttggttttgaatttttgattttaggtgatttatttattttggttttttagtgttgggattagaggtttgagttattgagtttggtttttattaatttttaaaatatgtattatttatatgaagtaaaatgtataaatattttatatatattttgtgtttttgtatatatatatatatatttgaatattttaagttttttagagggttttttgtggtttttttgaagttagatatttttgtttaggaagaattattttttgattttttttattatatgttgggtttgattgtttttgaatgttttataaataaaattatataggatgtatatgttttatttatttggtttagtagaatgtttgagttttatttatattgtgtgtagtagtttttttttttttattgttgtgtattattttattgttaaatttattataatttatttaattattttgttgaattttttttgtttttaaagtatttgagattaaatttgtgatttagtaaggtttgtgtttaatagaagagagtttaatgtatgatagagaatagattttagagtggtttttttattaaaaggagaaggaaagatttggttagaagagttttttagaaatagattttagataatttttttgtaataggatttgttagggttaaatttatttattttgttaaaggtttgtagaagatgatatgagtaggggaatattttttttttttattttttgtttaatttagtaaatagtttttttttttgattagttatttttgtgagtttggttttttattgatttttatatttttttgtatagtttgaaaggttgatttttattttttttttagttaatttaaaatttaagtggaaattttttttttgaagatagtggggtttgtgtaatttttggttggggttagagatttaaaattaatgtttttttgattgatagtttttttatttatatttttttttaggagtttttattttagtgttatgtttttgggggtgggtatattttattagtggtttttgttaattttttggttattaagatatttttttttattttatggtaatagaggtgatgttatttattgtggattttagatttgtagtgtatttttttaggattatataggtaaatagtttttttttataatttttaaaataattttagtaggtattttagatttggggtttttttttttttttatttaatatttttatttttgtaggtatgtttaagtaggtttgttttgataaggatttttataaattttgagttttgttggttatttttttttttttagatttagttgaagaaatgttttttttttaaaattttagattataaggttgggagggttttaaatattaatttaggaaaagtaatttttttattttgtatgtggtttatagtttgtttttggtatattttttttatagagggaaaaagtattaaagatttaagtgtagggttttagatttaaatgtttaggaggtaggtaggattatttattgggatggagaaagaaatagaaaaatagtagagttttttgttattttttatttttattttagttaggagttttttaatgagtataattttattaggatagtagtaagatataatttttaattatataaatattaattataagaggtgaatgtgtatatattttattgtatatgagatatattagataaagttagagatagtagttttatatggtgttttgttgttttttagggttatattttggttgtgagatatagtgttgatggtagggatttagaatgtttagtgtttaagtttaaggtttgttttgttatttattaatgtaaatttttagtaaagttattttatttttaagaatttgattttattggtttaggatgtagtttgagaatttttaatgtagttaggattgagagttttttgttatttattttatattttttaaatgtatttaatttgttatttgatatggttggagagttttgagaattaatttgaataatattgttttaaagttttaggagtttttatttttgattaaaatttatgttattaaaagaatataggggtttgaatttagaagttaagatgttatgtgttttatagggaagagtgagtgaggtaattttattttttttgtttttttgtaaggttgatgtttagttttagtttttattttatttttttagttgtatttggagatgttatttgtttaaagtaggtttattaaggtttgtttttaatttaatatagaaggtaatgtttttgaatgttatatgtgtttagtgaatttgtttgtttagtgtagaatattatttttagtaagtattaaatatatatatatatatatatatatagatattgtattatagtattttatttgtttttatttgtttattagattgtgatttatattggtttgggggttaggggaggttagatattatatttaatttgtttttatgttgttatagggtttggtataaaattagtatttagtgtgtttgttgaaagaatggggttttaattgtgttttgtgaatgggttgagagtaggtgtttttatattgaagtgttagtaaaattagggaatgggatatagaagggtttgtgagtgttgagaaatgatattaaaagtatgtggggggatatgagagggagtggagaggggaggtggggatgtgtgggtggggggtgtagggggtatgtggtgagggggtagtgtttaggggaaagggttgtttatgtggagtatgtatatgtattgtgtgtgtgtttatagaatttgtagattttattagttttttaaagggttgtgattttaaaagtgtaaggattataggaatagattttataaaataattagtagtgattagaaggaattagtttttttttttgaaaggttgaagttggtattaaatgttttagtttagtagaaattgaaggagggttgtattagattgttaaggtaaagtagatgtgagtattttttatatatttgtttttaatatagtaattggagatttggtatttttggaggtgattagggatttttagtatttatttgttttttttagtgtattataagttgggagaaataagagtttattgtatttataagtatgtataagggaatttagtttttgaattgtttgttgatagttagtatattttttttttttagggtgggattagtggttttattaggatttttatatttttgtttattgggtttttttgttattgtgtatttggttgttttttttattagaaagaaaattaagagttttttttgtatatttttagtgaatatgtttgaaatttagatagataaaatggataattttttagaaagatagagtttataaaaattgattttagtagaagtagaaagtgtaaagagattaatttttatagtatagagaaagttattaagaaataattttataaagaagtattaggtttaggtggttttatagaggaattttattatagttttagagattagggagttttagggagatagaaattatttttgagtttagaaaaggaaagaaatttaaatttgatagtataaaaaataggttaatatgaatattatttatgaatattgaaaaatgtttaaatattatttgatgttataattattttaagaaaataatatattaagtggagtttatattaaggatgtttttatataaagaaatttaataatgtatgttaatatattaataggtttatgaagaataagattatatttttttatagatgttaaaaaagtttttgatataatttaatttttatttgtaataaaaatttttgggggaaaaaagaaagaattaatattttttttatataatttatatattttaattttaaagttaatattggagtttttttttaaggtaaggatgtttattgtttttattattatgtaatattttattggaggtattagttaatgtaattagataagagaaaataatagaggtataattagaggtagtagtttagagaggataggatttgggttttattttttgttgtgattttaggatttaatatagagggtgtttaatagttgaatgagtaaataaataatggtttatattaattgaatatttttattaataaaagtaagggtttattaaattattagtaatagattatatgttgtgttgatttaaatgggttaatttatttaaggtaggtaatggttttatgaggtaagtggtattattttagttattttatagataagtagatagatgtttagagagatgagatgatttgtttaagattattttgttggtaaataaggtttttaattttagttttgttatggttttagatattttgttaattggtttgtatgtgttttttattaaatgagagaatgaggattttaatataatagtttagaatatatggtatggagtaatattgtttattttgggaaaattattttatttttttgtgttttagtgtttttttttataaaataggggtgataatagtgtttgttttttagggttggagtggaattatatgggttaatgaatgtttgttatatgttaaattttataaaatgagtatttgatttttttaaaattttttaatttatttttattaattttattaataatgtttgttttattagtagtatttttttttttttggtttttgttaagtttgtgtttagagttaaggatagaattttatatgtgttattaatatgttgttatttgggataaaatttaataaaaagattaaggttagtgtttatttttgaggagttttattatatagaagtaaagagaggtgattgttattaatatttgggtgatttagagttagatgtatatttggggtagtttatattagttttttaaagtttattatgttttttttttttttttgtttggtttgttggtttgagatagggttttgtattgttttatgggttggagtgtagtggtatgattatggtttagggtagttttgaatttttggggttaagagatttttttatttaagtttttgagtagttgggaagttgggtttataggtatgtgtaattaggttaggttaattgttttatttttttatttttattagagatgaggttttgttatgttgttttagttggttttgaagttttggatttaagtaatttttttattttgattttttaaattgttgggattgtaggtatgagttattatttttggttatagtattttttttttttttgggtgttaatttttttgtgttgtttattttttagtaaagagtaagtgttttttagattttggagtattattttgtattttttaagtgtgggttttatgtagtaatgttttttaaagagtttgaagaaattgagaaaagttatttttattgggtaattaaggttagtattaatgataaatgatatggatagtatattttttgttgttgttttttgagatagagttttatttttgttatttaggttggagtgtaatggtgttatttgttttattgtaatttttgtttattgggtttaagtaatttttttgtgttatttttttgagtttttggaattatagtgttttttattatgtttggttaatttgtgtatttttagtagagttggggttttattatgttggttaggttggttttgattttttgattttaggtgatttgtttgttttagttttttaaagtgttgggattataggtgtgagttattatgtttggttggatagtatatatttttgatatgatgtgatgagaagggagttttatttttgtgggtttttttttgaaaatttagagttttagtttaatgaagggatagtttataatataattaatattttttaaaatagtgaaggttatataaaatatttttaatttgaataaggtataaattttagttaataatgtgttaatattggtttgttggttataataaatgtattatattaatgtaaaatattaataatatggggaaatagggtattgggtatatgggaattttttgtgttatttttgtaatttttttgtaaatttgaaattgttttaaaaattgaagttttttttttgtttttttttttttgagaaaatagattttagggtttttattgtggttatttagatatttatttggtggttattaagtagtatttgttaagaaaaattataaaaagtatttttttttagatttggtttggaaattatttttttggaaatttttttattttatttgataaggaaaataaaagttgattattaatttgggaggggtgtgagtatttgttttttgaaaaatatgattttaattttaatgaatagaaagattatggatattagtgtggattgtttgtagatttttaattgtatttttttaaagtaaaagatgttttttagattgtaattttagaagattggttttttttgttggttaattgtttttatttttagttaagatataaaattattattaatgattatttttgggtatttaagggaagaggatatttaaagttaaagtaaattttttatttaatgtggttagagaggatattgatggaagtgaaaattttattatttgtttaatatagtgtttgtgggaaatattaggttattaagtttttttgataggttttttttatgagttagttagtataagttttttttatatattagatggaggtaagtttagagtgtgtttggaagttattaataggtttgttattgagtttttaataagtattggttgggttgggttgggttgttaaaattaggaagtttggttgggttttttgttttttttaagataatttgttaattagaaatatatagtgaggttgggtgtgtggttgtttttttttttttttttttttttttttaatgaatgtttttgttaaatatgtgaagtgatagataagtattgggtttagtttggggaagtttttagtttttagtaattgagggtagttggaggtatagagtgataaagtttaggtagaaagagtttgtgtttttttgaatttatgttgtagttgttttttattttattttattttattatatttattaggattaagtgtagaagattatttaatatagtttagattaatttttttgtgagtggtaagtgatgggtttagtagtagaatttagggaggaaatgggttggttttataatattaaaggttttaattttttttagtattagatagataattttttttttagttttaatataaagtttttgttaattattgtttataggaggtgatgggagttgtgtggttttattttagtgtttggagggaaggagtggttttttatttttgataattgggtttagttgtattttttttttttttttttttggtaatttttttttgttaattttattttttgtttttttattttttttttttaaaggtatagaaattatgttttttgttttttgatagtttagttttaggtaagaggttagtagatagtatttgttttttagttttgggatttgtttgttattttttgttttgttgagagtgatttttagggagtagttatgagtaattagaaattggtgtttttaaggggtaagagggagttgattgttttttaagggtggtaggggttattgatgttttttttttttggtatttgggtaggggtattttttttttaggttttttaggaagggggatggttggagttaagaggatttttgtgtttagtttttaggtttgagtttttggtgggtttaggggttaggttaggggtagtttttattgatttttgtttggatttaaatatttatagttgaagaggatggagaagttaagtttgttttgggggttgtttttaggtttgtggtttggggtgtttttgttgttgggttggggttgttgtttgggggtgtttatggtgtgtagggtgggaaggttgtggggttgggggtgagggtgggtgtggttggttttgggattttttgtagtggggttggtggaggtggtttgagtggtggggtttttttttttgtagggatgtatgttgggtttggggatggtgtgtttggtgtagtgggttttggatgtgtttggggaagttgagtggtggtggtgatggtggtgtgagttttttgttttggaggtatttgttgtagtttggggaggtggggggggggggggtgtggaggtggggatagggtggttaggttggtgggggtggggttgttattaggggattggaggggaggggtgtgtggtttgggttggttggtgttgggaggaaggaggttgtttgtggatttgattatattgttttgggttattgttgggtgttggggtggttgttgttttttattttttatgggtgagtgtgatatgtgttgtgtgaattagggtttagataagaaagttgttgttattaggatttttgttttaagggatttattggttttatatttttttttgttttttttttttatggggtggaagggggtatttatttttttttattgtagatttgtgtttttaggtgtttttgtgtgtttatgggggtggtatgatttttatagtattttagatatttgtatggttttgaatttaattttttagtgtttaggaaggaattggattgatagtattagttttttttgttatagttatgttttttggttatttattatgtgttaggtgttgggtatttagttggagttagatattgttgtttttggaagtttaggttttggtagtgggagaggtttgaaggagagaaataggataaaaagtatttgtttatggggttaggagagaatttattagggtatgggataaaggttggggtggttttagttttttgggtggttaaggaggatttttttgaggaggtgatatttgaagaaatttgattgatgaggtgattttggggaagtgtgttttggtagtgagaattaaaatatagagttagagtttgaaggggttgggtgtgttggagggagaatgaggagtatagttttgatggggtggttggtaagtgataaatatgtttggttgtttgtttaaagtatgatttttaggtttttttttggagtttttgattttataagtttgaatatagatttgtgaatgtgtatttttaattaagtatttaatgtgagtattaatgaataggtatatttggtaaatattgtataaggatttagtaattaaagaatattttttaataaaattttgttagggggttttattaatttagttgaagttggaaatagatttatagaggtagaaaagattaaaatagtggtttttaattttttttatatattagaattatttgggatatttttttaaatttttgtgttgggttgtaatttaaatttattgaagtagaatttttaatttttttttttttttttttttttttttttggagatggagttttgttttgttgtttaggttggagtgtagtggtgtgattttggtttattgtaagttttgttttttgggtttatgttatttttttgttttagttttttgagtagttgggattataggtgttagttattatgtttggttatttttttgtatttttagtagagatggggttttattgtgttagttaggaaggttttgattttttgattttgtgatttatttgttttggtttttttaagtgttgggattataggtgtgagttattatgtttggtttgaaaatttttttaaattttagatgaatttaaggtgtagttagtgttgaggatgagaagattagatgggagaggttttaagatttttgtgagaattatagtttgattttaagtgatttgaatttttttttatgtgttaggaggaattgaggatatgtattttttaggggagttattttagttttattaaggggatttgtgttaagttatttattattttataaatatttattgagtatttgtttggtattgttataagatgttggggatgtaattattaataagttatagtttttttttttattatgtttatgttttgaaagtaaagtagtatagttatgaatggggtttttaaaattgtatttagattagtggtttttaatttagattatatattagaattatttggagagttgttaaaatttgtatttaatgatttgagtattattagatattgatttgattagaatgtttggggttgggatttaggtattagtattttgtaaaagtttattagatgtttttaatgtgtggttagagatgagaattattttggtttagatttaaattttattgtaggggtttgggggttggtttaggaattattttagagttttgggtagtattttttggttgttagagtataaagaaattttagtttttgttttttaattataagtatttttgtgttatgtgtatttaataagtattttgggggtagttgatgtatttaggtggaggaaggaagagtgaagattttagttaggatatttatagataggtatttagaaagagatggatttttttgggtttttatgatagggatttaaggtttagatgatgaaattttggttaataaataagaaaattaggttttttttgtgatttagaaaaggagaaaagttaggaatgtttttttatatttttttttgtttttttattttataattattaagtgttattaaatttagtggatatttgttgattgtgtttatttagaataattttttttttttttttataatagtattttagtgtgttttttggggaaattattttaaatataattttggtagagttattaatttagttgttttattttttttaagtaatgaagtggatgaatgatttagattgtgttaattagagaattttatttttattaattagtttgagatttattaaggtaggggttatgattattttatttgtagttttatgtgtaatggatgtgtggataaatggaggatggataagtagatggattgatggatgggtgaatggaagatggatgtatggatggaagatggatggatggatgaatagatgggtggatggatggataggggatggattgatggatgggtgaatggaagatggatgtatggatggaagatgggtggatggatgaatagatgggtggatggatggataggggatggatggaagaatggatggatgatggatggaggagtggatggagggtggatggatggatggatggaggataaatggataaatggatgaatgaaagatatatggatggattgatggaggatagatggatgaatggatggatgaaagagtgaatgtgttgtatggatgagtggatttattaattaatggaagagtagatgtttgtttggatgaatgtagagtttgattttttttaaaatttttagagttttttttaagggttttttattttgaggtttattttggttatttaaatgttatggtaagaatttaaatttttattttaattttattttttttttagatatttaatgataaaatgagatattaaagggaagattattttgtaattgattaagtgttataaaaattttagtttgaggtaggattgtttaggatagtttaattgtttttgttgtttttttgaatagtggatatatttttaaagtttttaggatttggagtttggattattgtagttagagttttttaaaaggaagtgttttagattaggtgttaatttataaaagagtttttgttggatagtggggagtaaaagggtttttttttttaaaggttattttgaagggtgggagtttgggttgggggaaaggtatatttttaatttaaaaataaataatttgtgtttttaggaataaggtttaggagtagaatgtatgagttttatgtattgagagtgattttgggaggtggagggatggaggtgggatggtgatttttatagggtattgttgttaattttttttttattttgtgtttgattttttttggatattttggtttttgagtttttttttagtttttttaattgaagtgtaatagaaagttagtgaagttattgagattttgaaatttttagtatatattggtattatttgattttggtttaggaatttagttttttttaatatgtatttaatttatagtttaattatagattgaggtatgtgttgtgaaaggtaaggagaatgtgttatagagtttatgttaaggaaatttgatgtagatagggaatttagataaggttgttttagggaggtgatgtttaagttgggattggaaggttggtagaagttagttagggaatgatgaggggaggtattaatagagtgatgagggagtatgtgtaaaggttttgaggtaggaggaaagtatgaaatgatggaggatttgaaagaagataggagtggtaggtgtttagggaaggatgagaagatggtgtaagattaggttgggaggtaagtggggtttaggagattatgttgagagtttgggatttgaaagtaattgggaataattggagagtgttaggtagtatatgatagaattatagatgagtttttagatgatggttttgggttttttgaggatgagaaattgtaggggtaagggttgaagttggaggattaagtagatggtttttatagttgtttaggaaagagataatgggggtgtagattatagagataagtggtagttatagagataagaaaatgtggaaggatttataagatttatagattgttattttttggtttttttgtgagttattttttttttttttttaggtttttttaaaatggagtataatttgggtttatttggatagaaatagttaagaagtattgatttttgaaatgtttttaagaagttttttttattatttaaggtggttttgtgtttttaggttgttttaagatggttttggagttatttattatttatagttttgtttttttttttattttttggtagaaagtttatttttatttataatttgggtttttttatagaaatttaggtttgtatatttaatgatgatttaatatttttatgggagtatttaataggtattttagtgtgaatgtgtttaaaattaaattttatgtttttagttgtttttgttttattgtgttttaatttaagtattgttttgtttgtaatttagttttttaattaaatattaaagagtggtttttgagtttttgtttttttttatgtttatgtgtaaatttttagtaaaagtaggtagttgtattaaatgtaatttaaagttatttattttttattaattttattgtttttttttttattttttaagaatttaggtttttattattttttatttggataattgtagaagttttttttttggatttgttatttttatttttgtttttatgtggagtaattagagggagtttttaaaaaatatatatttgataaattttttagtggttttttattaaattaaaattaaatataaagtttttggtttgtaaggttttatgtaagttatgttttatttgattttttttgggtattattttttgttatttttttttttttttattttttttgttattttgattgtttgtttgttttttgataatgtttatatgattttattttagggtttttgtatttattgtttttttagatattgtttggttattattttattttgtttattttatagtttaaaagttatttgttagagattttttttgtttgttttaataaaaattgtattttttggtattttttgtttttttattttgttttatgttttttattgttttttttgttatggtgtattttatttatatgtatattttttttattgtttgttttttttatttgaatgtagtttttataagggtagggatatttgtttgtttttttttttgggatatttagggttgttaagtttagtaaatataaatataggatatttagttaaatttgaattttagataatgaatgttttttttagtagaagaagtatgtttaaaatagtatgtgggatagatataaattaagaagttatttattgtttatttgaaatttaaatttaagtggatattttgtatttttatttggtaattttagttgtatttttagattttagattggtatttagtatatggtagttttttattaaaaagtagttgaaggaaagaatggaagaatggtgtttaatagagtttttatttgagattaattagtgaataaaattgtattattaggagaatttaaagttttttttttgtttagttttatgggatttaatagggatgttttgaaatttagtagtgttttgtagttttggtagtttagtttttagtttggttttaatatttgtaattatttgtagagaaataatatgttatttgatttaatggttttagggaaattttatttgtatatgttgtttaaaaagaaaaagagtttggtatagtggtgtatatttgtagttttagttatttggagattgagatggaaggattgtttaagtttatgagtttgagatggtaatgtgtgataattttatttgtgaaaattatagtattttagtttaggtaatatagtaagattttgtttttaaaataaggagtgagagaaaaaaaaagaatattataaaagataatgttttgttatagaaaatatgtaaatagttttttgaggttttttggtttttttgtttgtttgtttgtttgtttgtttgagatggagttttgtttttgttgtttaggttggagtgtaatggtgtaattttagtttattgtaatttttgttttttaggtgtaagtgatttttttgttttagttttttgaatagttgggattataggtatgtgttattatatttagttaatttgagttttttataataagattggtatatatgaattttttttattttttttaggttgatttttttgttgaaggttaatggtatgaagatataaatgtttgattaagtttggagtgattttgtgatatattaaagaataatttagagttgggaggtttaggatttaaattgagtttttttttttattttgtgatttttaagtaagatatttttagtgttttagtttttttgtttgtaaaatgggaagagatgaattagataatatttgagttattattttagttttaaaatttaaggattgtttaataaggaaaattaagttaatttgagtagtagttggggtttgttttatgggatgtgatatgtagagttatatggtattttgtatttggaataatttgtgtttagaaggagtttgtatttggttgaatgttttgttgttgatattttttaaattttgaatattttttgaataagaggtgatgtatttttattttgtataatgttttgaaaattatgtagttggttttgatagtgtataagtgttttttaatttatggtgggtgatattttaatatatttatgatatattgaatatattgttgggttgaaaatgtatttaggtagggtatggtggtttatgtttataattttagtattttgggaggttgaggtaggaggatggtttgaggttaggagtttgagattagtttaggtaatatagtaagattttgtttttatgaaaaataaaaatatattagttgggtttttatttgagtttaggagtttgaggttgtagtgagttatgattgtattattgtattttaaaagagtaagattttatgtttaaaaaataataataataggttaagtatggtggtttatgtaagtttgtaattttaggattttgggaagttaaggtgggtggattatttaaggttaggagtttgagattagtttggttaatgtggtgaaattttgtttttattaaaaatataaaaaatagttaggtatggtggtgggtgtttgtaattttagttatttgggaggttgaggtaggagaattgtttgaatttgggaggtggaggttgtagtgagttgagattgtgttattgtattttagtttgggtgataagagtgaaattttattttaaataataataataataataataaatataaagaaaatgtatttaatatgtttaatttattgaatattatagtttagtttagtttattttaaatatgtttagaatatttatagttatttatgtaattgattttaggtaaaataatttaatataaagattattttataatgaggtgttgaatattttttgtaatttattgaatattatattaaaagagaaaaatagaatggtttatgggtatttaaagtatagtttttattgaatttatattgtttttatattattgtaaagaaagtttaagttaaatattataagttagagattatttgtataatatataagttatatatttttattatgaattttatgttttaataattttttattataataaaatattgtttataaaaggtaggtattgaaatgttttaagttggatttaaaaagtgggaatattttttattagattttaaaaattatttttttttaatggaagtattttttgggatttatgattattttaggtgttaatatataatttatatatagatgtatttgattttagtaaggttggtattaaggtgaggtaagagaggtaaaatgaaagagggtattaaaaatttagtaattagataaattatatttttatattatgttttaaaatattaaaatgaatgtaaaaaaaaatttttgttgaataagttattataattttaataaagatagggttagtaatagtttatgtgagttatattgtattttaaggttatagggaaaatgagtaatgttgattttgtttttatttaatatttttatttatttattttttttgagatagggttttatttagttatttaggatggagtgtagtggtgagagtatggtttattgtagttttaatttttttagtttagatgatttgtttattttagttttttagtagttggggttataggtttttgttattatgttttgttattttttttttttttttttttttggagagataaggttttattatgttgtttaggttggttttgaatttttgggtttaagttattgtatttggtttttttaaaaaaagtttattatggagttttggtatgataagttaaaattttaaaataaaaattttgttttaaaaatattatattaggttgtatatagtggtttatgtttgtaattttagtatattgggaggttaaggtgggtggattatgaggttaggagattaagattattttggttaatatggtgaaatttaatttttattaaaaatataaaaagttagttgggtgtggtggtgggtgtttgtagttttagttatttgggaggttgagggaggagaatggtatgaatttgggaggtggagtttgtagtgagttgagattatgttattgtattttagtttgggtgatagagtgaggttttattttaaaaaaaaaaaaatgtgtattaaaatatggtttattttgggtttatgtttgtaattttaatattttgggaggttaaggtgggaggattgtttgagtttaggagtttaagattagtttgggtaatatagtgatattttatttttatgaagttgaaataggaggatggtttgagtttaggaggttgatgttgtagtgagttgtgtttgtgttattgtattttagtttaggtgatagagtaagtatttgttttaaatatatatatattttatatatgtatgtgtgtttgtgtgtgtatatatatatatatatagtttattttgattattgaattttttgtattttgtttttttaaatgttttattggtttttttatgtttttgtaaagttatttttagggatgagttttttatagattgagaaaataagatagttttaaatttgatttgtattttaatttattattttttatagagttttttaaagtttgaagaggatttttttgttgtgagaaaattattttttaagaggggattgtagtaaaaggttgttagttgaatatgttatttttttattgggtaggtattgatggttattagtattttgtaagatagtagggttttattaaaagttaatatttaaattaatgggtggattgtaggaagatgttttatttgatagtagtagaagttataggtttgtaggagttttattaagtttattttgtaggtatattatgtttggtttgtttagtaatttatttttaatttgaattaatatttttattttttttaattatatattaagttttgggatatatgtgtaggatgtgtaggtttgttatattagtaaatatgtgttatggtggtttgttgtatttattaatttattatttaggtattaagttttatatgtattagttatttattttgatgtttttttttttgtatttttttggtaaggttttagtgttttttgtttttttttttgtgtttatgttgaattaatatttttaaattgggagattttatataaaagtttaaaattttaattttttaaaaaaaaaaggtaggtagattttgttattttaggtttatatttttgtatggattaattggttggaggtgagtagaggttgttttttggggatgtttttttttgtttgttttagtttttatttgttttttttatttatttgttttatttgttgggagtttgtgagtttgagtgtttgggttgtagagttttgattttttttatttggtttttgtataattattttgttttggttttgttttttttttttgttttttgttttttagtatgtttttttttgttttgggtaaaaatgtttagaaggagggtaggtgtgttgggtgtggtggtttatgtttgtaattttagtattttgggaggttgaggtgggtggattatgaggttaggagattgagattattttggttaatatggtgaaattttgtttttattaaaaatataaaaaattagttgggtatggtggtaggtgtttgtagttttagttatttgggaggttgaggtaggagaatggtatgaatttggaaggtaggagtttgtagtgagttgagattatgttattgtattttagtttgggtgatagagtaagattttattttaaaaaaaaaaaaaaaaaagagggagggtaggtttagtaaatttgttttttttttaaatgatggtttttgattttaattgaataggagatgttgttatttttttgttagggaggttttattttttattaaggtagaattttaaggggtagggtgggtagggttggtttgttaggggatagagtattggttaatatttgtttatttttataattattttttatttaatgtatttgttattgttggtttattgtttttttttagttatttaagttgtttttttttgtatgttttaagattatttttttttttatttttttttttgttatattttttgtagatttaaatatttgtattgattttttaatttttgaagttagggagtgatgaggataagttggttgatttagaggtatttgttattagtttttatttgtataattaaattttggagtatatatttttattgtttttaaaaaagtataagatattg

SEQ ID NO: 74 - DNA, 25681 bp, Artificial Sequence
  chemically treated genomic DNA (Homo sapiens)
tgatgttttgtgtttttttggaggtggtgggggtgtgtgttttagggtttagttgtgtggatgggagttgatgatgggtatttttgagttagttagtttgtttttattattttttgattttaaagattaggaaattggtatagatgtttgagtttgtaaagaatatggtagggaagagaatggagagagaaatgattttggggtatataggggaagatagtttgggtgattgaggggggatagtgggttgatggtgataggtatattgagtgagaaatgattgtggggatgggtagatattaattaatattttattttttaatgaattagttttatttattttgttttttgaggttttattttggtagaagatggagtttttttggtagagggatggtggtattttttgtttagttaagattaaggattgttgtttaagggggaggtaggtttattgagtttgtttttttttttttttttttttttttttgagatggagttttgttttgttgtttaggttggagtgtagtggtatgattttggtttattgtaagtttttgttttttaggtttatgttatttttttgttttagttttttgagtagttggaattataggtatttgttattatgtttggttaattttttgtatttttagtagagatggggttttattgtgttagttaggatggttttgattttttgattttgtgatttgtttattttggttttttaaagtgttgggattataggtgtgagttattgtgtttagtatgtttgttttttttttaaatgtttttatttaagatagaggggaatgtgttagaaagtaaggaataaagaggagaaataaaattagggtaaagtagttgtgtggggattaggtggaaggaattaagattttgtagtttaggtgtttaagtttataggtttttggtaggtggaataaatgaatgaggaagataggtgggggttggggtaaatggaggagggtatttttagggaatagtttttatttatttttagttgattggtttatatgggaatgtaggtttggagtggtgggatttgtttgttttttttttttaagaagttggaattttggatttttatgtgaaattttttaatttaaaaatgttagtttgatatggatatagggaggagaataagaagtattggggttttgttaggaaggtgtgggagggagagtattaggataaatagttaatgtatgtggggtttagtatttaggtgatgggttgatgggtgtagtaaattattatgatatatgtttattgatgtaataaatttgtatgttttgtatatgtattttagaatttaatatataattaaaaaaaataaaaatattagtttagattaaaaataaattattgggtaggttaaatataatatgtttgtaggatggatttggtggagtttttgtagatttgtgatttttattgttgttaaatggggtatttttttatagtttatttgttgatttgggtgttggtttttagtagaattttgttgttttatgaggtattgatggttattagtgtttgtttagtgggagggtggtatatttaattaatggttttttgttgtaatttttttttggaaaatagtttttttataatagagaagttttttttgggttttaaaagattttgtaggagatgatagattggagtgtaagttaggtttgaaattgttttgtttttttaatttataaggagtttatttttaaaaatggttttgtaagagtatgaggaagttaatgaggtatttgggggagtaaaatgtaagaaatttagtaattaggatgaattatatgtatatatatatatatatatagatatatatatatatatgaaatgtatatatatttgagataggtatttgttttgttatttgggttggagtgtagtggtatgaatatggtttattgtagtgttagttttttgggtttaagttatttttttgttttagttttataaagatggggtgttattatgttgtttaggttggttttgaatttttgggtttaagtgatttttttattttggttttttaaaatgttgggattataggtgtaagtttaggatgaattatattttaatatatatttttttttttttgagatggagttttgttttgttgtttaggttggagtgtagtggtgtgattttagtttattgtaagttttattttttaggtttatgttattttttttttttagttttttgagtagttgggattataggtatttgttattatatttggttaattttttgtatttttagtagagattgggttttattatgttagttaggatggttttgattttttgattttatgatttgtttattttggttttttaatgtgttgggattataggtatgagttattgtgtgtgatttaatataatatttttaaaataaaatttttgttttaaaattttggtttattatgttaaaattttatgataagttttttttaaaaaggttagatgtggtagtttgagtttaggagtttgagattaatttaggtaatatagtgagattttgtttttttagaaaaaaaaaaaaaaaaaaaatagtagggtatggtggtaggagtttgtagttttagttattaggaggttgaggtgagtggattatttgagttggggaggttgaagttgtagtgagttatgtttttgttattgtattttattttgggtgattgagtgggattttgttttaaaaaaaataaataaataaaaatgttaaataaagataagattaatattatttattttttttgtggttttagggtgtagtgtggtttatatggattgttattgattttgtttttattaaaattataatagtttgtttagtgaggatttttttttgtatttattttgatgttttaaaatatggtgtgaagatataatttatttaattattgagtttttggtgtttttttttattttattttttttgttttattttagtgttagttttgttggagttaaatgtatttgtgtataagttatatattaatatttagagtgattatgagttttagggaatgtttttgttgaagggagatggtttttggagtttggtaaagaatgtttttattttttgaatttaatttaaaatgttttaatgtttgttttttataagtagtgttttattataatgggaggttgttaggatatggagtttatgatgaaaatgtgtgatttatgtgttatatagatggtttttgatttatgatgtttgatttaggttttttttatgatggtgtgaaagtgatatgagtttagtagaaattgtattttgggtatttataaattattttgttttttttttttggtatagtatttaataaattatagaagatatttaatattttattataaagtagtttttgtgttgggttattttgtttaaaattaattgtgtaggtgattgtaaatgttttgagtatgtttaaggtaggttagattaagttatggtgtttagtgggttaagtatattaaatgtattttttttgtatttattattattattattattatttgagatggagttttgtttttgttatttaggttggagtataatggtgtaattttggtttattgtaatttttattttttaggtttaagtgatttttttgttttagttttttgagtagttggaattataggtgtttattattatgtttggttattttttgtatttttagtagagatggggttttattatattggttaggttggttttgaatttttgattttaggtgatttatttattttggttttttaaagttttgggattataggtttgtatgagttattgtgtttggtttattattattattttttagatatggggttttatttttttggaatgtagtggtgtgattatggtttattgtagttttaagtttttgggtttaaatgggagtttggttaatgtatttttattttttatagagataggattttattatgttgtttaggttggttttaaatttttggttttaggttatttttttgttttagttttttaaagtgttgggattatagatgtgagttattatgttttgtttaaatgtatttttaatttaataatatgtttagtgtattatgggtatattgggatattatttattataagttgaggagtatttgtatattattagagttggttatataatttttagggtattgtgtgaaatgaaaatgtattgttttttgtttaaaaagtatttagaatttaaaaaatgttaatagtagagtatttaattaagtgtaggttttttttaagtataggttattttaggtgtggaatgttgtgtgattttgtatgttatattttatgaagtgagttttggttgttatttagattagtttggttttttttgttaaataatttttgaattttagagttgaaatggtaatttaggtattatttaatttatttttttttattttatagatagagaaattgaggtattgaaggtgttttgtttaaaggttatagagtgagaggaagaatttagtttggattttgggttttttagttttgggttgttttttaatgtattataagattattttaggtttggttagatatttatgtttttatgttattgatttttagtaggaaagttagtttggaaggggtggaaggggtttatatgtattagttttgttgtaaagaatttaaattagttgggtgtggtggtatatgtttataattttagttatttgggaggttgaggtaggagaattgtttgtatttgggaggtagaagttgtggtgagttgagattgtattgttgtattttagtttgggtaataagagtaaaattttattttaaataaataaataaataaataaataaaaaaattaaaaaattttaagaagttatttatatattttttataatagaatattgttttttataatatttttttttttttttttattttttgttttggagatggggttttgttgtgttgtttaggttgaagtgttgtggtttttataggtgaaattgttatatattgttgttttagatttatgggtttgagtgatttttttattttagtttttaggtagttggaattataggtgtgtattattgtattaggttttttttttttttaagtaatatgtgtaggtagaatttttttgaagttattgagttagatgatatgttatttttttataaataattataggtattggaattaggttagaggttgggttgttaaggttataaaatattgttaaattttaggatatttttgttgagttttataaagttgagtaaagaagggattttgggtttttttagtggtgtagttttatttattgattgattttaggtagaagttttgttgggtgttatttttttatttttttttttagttgttttttagtgagaagttattatgtattgggtattagtttaggatttggggatatagttggggttgttagataaaaatataggatgtttatttaaatttgaattttaggtaaataatgaataattttttagtttatgtttgttttatatattattttggatatattttttttattaagaaaagtatttattgtttaaaatttaaatttaattgggtattttgtatttgtatttgttaaatttggtaattttagatattttagggaagaaaatagataaatatttttgtttttgtggggattgtatttaagtgaaaggaataggtaataaaagaaatatatatatgaataaaatatattatagtggaaagggtaatgaggaatatgaagtagggtgaggagatagagaatgttgggggatgtgatttttattaggataggtagggaaggtttttaataggtgatttttgagttgtgaaatgaataaagtaaggtagtggttaggtaatatttgagggaatagtaagtataaaggttttggggtggggttatgtgggtgttattaaggaataggtggatgattagggtggtagagggagtaagagaaggggagaatggtaggagatgatatttaaggagagttaggtgggatgtagtttatgtagggttttgtagattaagggttttgtatttaattttaatttaatgggaagttattggagggtttattagatgtatattttttaaaggttttttttggttgttttatataggggtaaaagtagaagtagtaagtttagggaggaggtttttgtagttgtttaagtaagaaataatgaaggtttgaatttttgggaggtgggaggaagaatagtgaagttagtgagaaatgggtggttttgggttatatttggtgtaattgtttgtttttgttgagggtttgtatgtgggtatgagaaaaggtgaggatttaagaattattttttggtgtttgattggagaattggattataggtagagtaatatttgagttgaggtatagtgaggtaggaatagttggagatgtagggtttggttttggatatatttatattgaggtgtttgttagatgtttttgtggagatgttgggttgttattggatatataagtttggatttttgtggagaggtttaggttgtagataaaaatgagttttttattagaaggtggaaaggaaggtagagttgtaggtggtgggtaattttagggttattttgaagtagtttggggatgtagagttattttgggtggtaggaggagttttttgaaggtgttttgggagttagtgttttttgattgtttttatttaggtggatttaaattatgttttattttaaggaagtttagaagaggaagagaggtaatttatagagggattaaaggatgatagtttatgagttttgtgaatttttttatatttttttatttttatggttattatttgtttttgtagtttatgtttttattattttttttttggatggttataagaattatttatttggttttttggttttaatttttgtttttgtaattttttatttttagagaatttagagttattatttaaaaatttgtttatgattttgttatgtgttgtttaatattttttagttgtttttaattgtttttaggttttaaatttttaatatggttttttgggttttatttattttttagtttgattttatattatttttttatttttttttgagtatttgttatttttgtttttttttgggttttttattgttttatattttttttttgttttagagtttttatatatatttttttattgttttgttagtatttttttttattattttttaattaatttttattaattttttagttttagtttaaatattgtttttttagggtagttttatttgaattttttgtttatgttaggtttttttgatataagttttgtaatatattttttttgttttttatggtatatattttagtttgtaattagattgtgggttaagtgtatgttgaagggagttgagtttttgggttagggttaaatagtattaatgtgtgttagaagttttaaagttttagtggttttattagttttttgttgtattttggttggagaggttggggaaaaatttagaggttagggtgtttaaaggaggttagatataggatagagagaaagttgatagtgatgttttgtgaagattattattttatttttatttttttattttttagagttatttttgatgtataaagtttatgtattttgtttttggattttgtttttaagagtatagattatttatttttgaattgaaaatatgttttttttttagtttaaatttttattttttaaggtaatttttagggaagaagatttttttattttttattgtttagtagaaatttttttatgggttggtatttagtttgaagtatttttttttaaagaattttgattataatagtttagattttaaattttagaagttttgaaaatatatttattgtttagagggataataaaggtagttagattgttttgaatggttttgttttaggttgaaatttttgtagtatttgattagttgtaaagtgattttttttttaatattttattttattattgggtatttgaagaggaagtggaattggggtaagaatttaggtttttgttatagtatttgggtggttagggtaagttttagggtggaggatttttaaagaaaattttaaggattttaaggagagttaaattttatatttatttaggtaaatatttatttttttattgattaatggatttatttatttgtgtaatatatttatttttttatttatttatttatttatttattttttattaatttatttatgtattttttatttatttatttatttatttattttttatttatttgtttatttattttttatttatttttttatttattatttatttatttttttatttattttttatttatttatttatttatttatttatttatttatttattttttatttatgtatttattttttatttatttatttattaatttattttttatttatttatttatttatttatttatttatttatttattttttatttatgtatttattttttatttatttatttattaatttatttatttatttattttttatttatttatatatttattgtatataaagttgtgaatgaggtggttatagtttttgttttagtggattttaggttagttagtggagataaaattttttgattggtgtagtttgggttatttatttattttgttgtttggggaaggtggggtagttgggttgatagttttattaagattatgtttagagtagtttttttaaggaatatattggggtgttgttatgagaagaagggaggaattattttgggtaggtataattaataaatgtttattagatttagtggtatttaataattatgggatggagggatgagaaaggatgtggggaggtatttttagtttttttttttttttaaattataggggaagtttggtttttttgtttattggttaaaattttattatttggattttgggtttttgttataaggatttagaagaatttatttttttttagatatttgtttataagtattttagttggggtttttattttttttttttttatttaaatgtattagttgtttttaagatgtttgttggatatatatggtatagaagtgtttatagttaggaaataaaggttggaatttttttatgttttgataattaggaggtgttgtttaagattttgaaatgatttttgagttagtttttaggtttttgtagtagagtttgagtttaaattaaagtggtttttatttttggttatatattggaagtatttggtgagtttttataaaatattgatgtttaagttttaattttaaatattttgattaaattgatgtttggtggtgtttaggttgttgaatataaattttaatagttttttaggtgattttaatgtgtagtttgggttaagaattattggtttgagtgtaattttgaaaattttgtttataattgtgttattttgtttttagggtataagtatgatgaagggagaggttgtggtttgttgatggttgtatttttaatattttgtggtagtgttaggtaggtgtttaataaatatttgtggaatgatggatggtttggtataaatttttttaatggagttgagatggtttttttgaagaatgtgtgtttttaattttttttggtatatggggaaggatttgaattatttgaggttaagttgtggtttttatgaggattttaagattttttttgtttaatttttttatttttaatattggttgtattttagatttatttgaagtttaaaaaaatttttaggttgggtgtggtggtttatatttgtaattttagtatttggggaggttgaggtgggtggattatgaggttaggagattaagatttttttggttaatatagtgaaattttatttttattaaaaatataaaaaagtagttaggtatggtggttggtgtttgtagttttagttatttgggaggttgaggtaggagaatggtgtgaatttagaaggtagagtttgtaatgagttaagattgtgttattgtattttagtttgggtgatagagtgagattttgtttttaaaaaaaaaaaaaaaaaaaaaaaaaaaaattaggaattttgttttagtgggtttggattgtagtttagtatgggagtttaaaaaggtgttttaggtgattttaatatgtgggaagggttgaagattattgttttgattttttttatttttgtgagtttgtttttaattttagttaagttggtggagttttttggtagagttttattggagggtgttttttagttattgggtttttatgtagtgtttgttaaatgtatttgtttattaatgtttatgttgggtgtttaattaaaaatatatatttatgagtttgtatttagatttatggaattagaagttttagggaggggtttgggaattatgttttaaataagtagttaggtgtgtttgttatttgttaattgttttattagaattgtattttttgttttttttttagtatatttagtttttttgagttttggttttgtgttttggtttttattgttagaatatatttttttaagattgttttattaattaggtttttttaaatgttatttttttagagaggttttttttgattatttaagggattaaagttattttaatttttattttatattttggtgagtttttttttggttttataagtagatgttttttgttttgttttttttttttaggttttttttattattagagtttgagtttttgagggtaatagtgtttggttttggttgggtgtttagtatttggtatgtggtaggtggttaggaggtatagttgtaatgggggggattagtgttgttagtttgatttttttttaggtgttggggagttgagtttagggttatgtaggtgtttgaagtattgtgaaaattatgttgtttttgtgggtatatggagatgtttggagatatgggtttgtaatagaagggggtggatatttttttttattttatggagaagaaaagtaggaaaaagtgtggggttagtgggttttttagggtaaaagttttagtggtggtagtttttttgtttagattttggtttgtgtagtgtgtgttgtatttatttgtggagggtgggagatagtggttgttttagtgtttagtggtggtttgggatagtgtggttaggtttgtggatagtttttttttttttggtattggttagtttaggttgtgtgttttttttttttggttttttggtggtggttttgtttttgttggtttggttgttttgtttttgtttttatgttttttttttttttgtttttttgggttgtaataggtgtttttggagtaggaagtttgtgttgttgttgttgttgttgtttagtttttttgggtgtgtttaggatttgttgtgttaggtgtgttgtttttggatttggtgtgtgtttttatgaggaaagggattttgttgtttgagttgtttttgttagttttattgtgaggggttttagagttagttgtgtttgtttttgtttttggttttgtagtttttttgttttgtgtgttatgaatgtttttgagtggtagttttaatttgatggtggggatgttttaggttatgagtttgggggtagtttttaagatgagtttgatttttttattttttttgattatgagtatttgaatttgaatgaaggttggtggaggttatttttggtttggtttttgagtttgttaggggtttaggtttggggattgggtataggagtttttttggttttagttgtttttttttttaaggggtttggagggagggtgtttttatttaggtgttagggaggggaggtgttagtggtttttgttatttttagggggtggttggtttttttttgttttttaggggtattagtttttggttgtttatgattgttttttgagggttatttttagtaaaataaaaggtggtaggtaggttttaaggttggggggtgggtgttgtttgttggttttttgtttgggattgggttgttaaagggtaagggatatgatttttgtgtttttggagggaggaggtgaggaagtgaagaatggagttagtagggaggagttgttaaaaaaagaaggaaggggggtgtagttgaatttagttattaagggtaggaggttgttttttttttttaggtattgaagtgaggttatgtagtttttattattttttgtgagtagtggttgatggggattttgtgttgaaattgaggaagaggttgtttgtttgatgttggagagggttaaaatttttggtattataaggttggtttattttttttttgggttttgttgttgaatttattatttattatttataagaggattggtttgagttatattaagtgattttttatgtttagttttaatggatgtggtgggatggggtagggtgaggggtagttgtagtatggatttagaaggatataggttttttttgtttgaattttgttattttgtgtttttaattgtttttagttgttgggggttggggatttttttgggttgggtttaatgtttatttgttattttatgtgtttaataggagtatttgttagagggaggaggaggaggagggggaagtggttatatgtttaattttattgtgtatttttggttagtaggttgttttggaaaaaataaaaaatttaattaggttttttgattttgatagtttagtttagtttagttaatgtttgttgaaggtttagtggtaggtttgttagtagtttttagatgtattttgggtttgtttttatttagtgtgtaggaagggtttgtgttgattggtttgtggaggaagtttgttaaggaggtttggtggtttgatgttttttataaatattgtgttaggtagataatgaagtttttgtttttattggtgttttttttggttatgttaggtgaggggtttgttttagttttgggtattttttttttttggatatttagagatggttattagtaataattttgtgttttggttggagatggaaataattagttaatagaagagattagttttttagagttgtaatttggaggatattttttgttttgaaaagatataattaagaatttgtaaatgatttgtattaatatttgtggtttttttgtttattaagattaaagttatgttttttagggaatgaatatttatattttttttagattggtaattagtttttattttttttgttgggtggggtggggggatttttggggaaatagtttttaagttaaatttgaagggaggtattttttatggttttttttggtaagtgttgtttggtggttattagatgggtatttaaatgattataatgaaagttttggaatttgtttttttaaaaaaaaaaaaataaaaaaaaaattttagtttttggaatagttttagatttatagaaaagttgtaaagatagtatagagagtttttatatatttaatattttgtttttttgtgttattaatgttttatattagtatggtgtatttattgtaattaataaattaatattgatatattattaattgaggtttatgttttatttagattgggaatgttttatgtgatttttattgttttgaggagtgttggttgtattgtagattgtttttttattagattagggttttaggtttttgggaggaagtttataaagataaagttttttttttattatattgtattaagagtatgtattatttagttaggtgtggtggtttatgtttgtaattttaatattttgggaggttgaggtgggtggattatttgaggttaggaggttaagattagtttggttaatatggtgaaattttaattttattaaaaatatataaattagttaggtatggtggaaggtattgtaattttagaaatttaggaggatgatgtaggagaattgtttgaatttagtaggtagaagttgtagtgaggtaggtggtattattgtattttagtttgggtgataagagtgagattttgttttaaaaaataataataaaaagtatattatttatgttatttattattaatgttaattttgattatttagtagaggtagttttttttagtttttttaaattttttggaaggtattattatatgaagtttatatttaaggagtatagagtaatattttagaatttggaaagtatttattttttgttgagaagtaggtagtatagaagagttagtatttagaaagagaagggatgttgtggttgggagtggtggtttatgtttgtaattttaataatttgggaagttgaggtgggaagattgtttgagtttagggttttaagattagttggggtaatatagtaagattttatttttaataaaaataaaaaaataaaataattagtttagtttagttgtgtatgtttgtagatttagttttttagttatttggaggtttaggtaggagaattttttaattttaggagtttgaggttgttttgagttgtgattgtgttattgtattttagtttatgggatagtgtgaaattttgttttaaattaataaattagataaaaaaagagaagggatatggtaagttttaagaggttaatgtgaattgttttagatgtgtatttggttttgggttatttagatgttaatagtagttatttttttttgtttttgtatggtgggattttttaggggtgaatattagttttaatttttttattaggttttgttttagatggtaatatattggtgatgtatgtaaagttttatttttaattttgggtatgagtttggtaaaaattaaggaaggaaaggtattgttaatggggtagatattgttgatagaattggtgaaggtaaattagggaattttggggaggttggatgtttattttatggagtttagtatgtagtagatgtttattagtttatgtgattttattttaattttaggaggtaggtattattattatttttgttttatggaggaggatgttaaggtatagagaggtaaagtaatttttttaaaatgggtagtgttgttttatattatgtgttttgaattattgtgttagggtttttatttttttatttggtgagagatatatgtaaattagttagtaaggtgtttgggattatggtagggttggaattgaaaattttgtttattaataaggtgattttgagtaagttattttatttttttggatatttgtttgtttatttgtaaaatggttgaaataatattatttgttttataggattgttatttgttttgaataggttaatttatttaaattaatatagtatgtgatttgttattagtggtttagtaaatttttgtttttgttaatggaggtgtttaattaatatgagttattgtttatttatttatttagttattgagtattttttgtgttagattttagggttataatggggaatgagatttagattttgttttttttgagttattgtttttaattgtgtttttgttgtttttttttgtttaattgtattaattaatatttttagtagagtgttatatgatagtgaagatagtgggtatttttgttttggaggaggattttagtgttggttttaaaattgaggtgtatgaattatgtaaaggaagtattagttttttttttttttttttgagagtttttattataaatgggagttgaattatattaaaggtttttttagtatttatggaaaaatatgattttattttttgtagatttattaatgtgttggtatatattattagatttttttatatgaagatatttttggtatggattttatttggtgtattatttttttaaggtggttgtggtattagataatatttaagtattttttagtatttatgagtgatatttatattggtttattttttgtgttattaggtttaggtttttttttttttttaagtttaggaataatttttgtttttttgggattttttggtttttaaagttgtgatagaatttttttgtgaagttgtttggatttggtgtttttttgtggagttgttttttgatggttttttttatattgtgggaattggtttttttatattttttatttttattggagttaatttttgtaaattttatttttttgggaaattatttattttatttgtttaggttttaaatgtatttattagagatgtgtaaagaagatttttaattttttttttagtggaggagataattaagtatatagtgatagaaagatttggtgggtaaggatgtgggagttttgatggggttattgattttattttggaaggggaagatgtgttggttgttagtagatagtttagaagttgaatttttttatgtatgtttgtgaatataatggatttttattttttttaatttgtaatatattgagagagatgggtgggtattgggaatttttggttatttttagagatgttggatttttagttattgtgttggggatagatatgtggggagtgtttatatttgttttgttttaatagtttggtgtagtttttttttaatttttgttaagttaaagtatttaatattaattttggttttttagaaaggaaaattggttttttttgattattgttggttgttttatagagtttatttttgtgatttttatatttttgaggttatagttttttaaaaagttgatgaaatttgtagattttatagatatatatatgatgtgtgtgtatgttttatatgggtagtttttttttttgggtattgtttttttattatatattttttgtattttttatttatatatttttattttttttttttatttttttttatatttttttatgtgtttttgatgttattttttagtatttatagatttttttgtgttttattttttaattttattggtattttagtgtaggaatatttgtttttgatttatttatagggtataattaaaattttatttttttagtaaatatattgaatgttggttttgtgttaggttttgtagtagtatagggataaattagatatggtgtttggttttttttggtttttaggttaatatgggttatagtttggtaaataaatagggataaatgaggtgttgtgatatagtatttgtgtgtgtgtgtgtgtgtgtgtgtttggtgtttgttaaaaatagtgttttatattaagtaagtaggtttattaaatatatgtgatatttagagatattgttttttgtgttgagttaaagataggttttaataagtttgttttggataaataatgtttttaggtgtagttggaaaggtgaaatgagggttagaattgagtattggttttgtagggaggtagaggaaatgaagttgttttatttatttttttttgtgaaatatgtggtattttggtttttaaatttaagtttttgtgtttttttggtggtatagattttgattaggagtagaggtttttaaaattttaaagtagtgttatttaggttggtttttaaggttttttagttatattaggtggtaggttaaatatatttgaaaaatgtagaatgggtggtaaggggtttttagttttggttgtattagaagtttttaggttgtattttggattagtgagattaggtttttgggggtaaggtaattttgttgagagtttgtattggtaagtggtagggtaggttttgaatttgggtattgagtattttaggtttttgttattagtattatattttatagttaggatgtggttttggagggtagtaggatattgtatggagttgttgtttttagttttgtttgatgtgttttatgtatggtgggatgtgtgtatgtttattttttatagttgatatttatataattagaaattgtattttgttattgttttaatgggattatatttattggaaaatttttggttaaggtagaaatgagaaatgatagggagttttgttatttttttgtttttttttttattttggtggatggttttgtttgttttttgggtatttggatttaaagttttgtatttgaatttttaatgttttttttttttgtggaagaaatatattaaaggtagattgtaagttatatgtagagtggggagattgttttttttgggttggtatttgggatttttttgattttgtaatttgaggttttggaaaaagagtatttttttagttgggtttgaagggaagaaagtggttagtaaagtttaggatttatgaaggtttttattaaaatagatttgtttgggtatgtttgtaaaagtgagaatgttaaatgagggggaaaaaaaattttaagtttgaaatgtttgttaaagttattttaaaggttatggaaaggggttgtttatttgtataattttaagaaggtgtgttgtaggtttaaaatttataatgggtgatattatttttgttgttatggagtagggaggaatgttttaataattagggggttggtaggggttattgatgaagtgtgtttatttttaggaatatggtattgaaatgaaagtttttggggaaaagtataaataaagaagttgttagttaagaaggtattaattttaaatttttgattttggttaagggttatataggttttattgtttttaagggggaagtttttatttggattttaggttggttgaaagaaaaatggaaattagttttttaggttgtgtgaggggatgtggggattagtaagagattaaatttgtagaggtggttggttggagagagggattgtttgttaagttgggtagaggatggaaagaagggatgtttttttgtttatgttattttttgtaggtttttgatagagtgggtgggtttagttttggtgagttttgttgtaggaggattatttgaagtttatttttggggaatttttttgattaaatttttttttttttttttggtgaggaagttattttgaggtttgttttttgttatgtattgaatttttttttgttagatgtagattttgttaaattatgagtttaattttaaatgttttaaaaatggagggagtttagtaaggtgattggataaattgtggtggatttgatagtgaaatagtatatagtaataaaaaagaaaggattattgtatataatgtgggtgaagtttagatattttgttgagttaaataagtgagatatatatattttgtatgattttatttatgggatatttgagaatagttaaatttagtatatggtgagaaaagttagggagtggttttttttgggtgagggtgtttggttttaggggggttatagagaattttttgggggatttgaaatgtttgagtgtgtgtatatatatgtaaaggtataagatgtatgtgaaatatttgtgtattttattttatgtaagtgatgtatattttaaaaattaatgaaggttgggtttagtggtttaggtttttaattttagtattgggaggttgaggtgggtggattatttaaggttaggagtttgagattagtttgggtaatatggtgaaattttgtttttattaaaaatataaaaattagttgggtatggtggtaggtatttgtaattttagttattagggaggttgaggtaggagaattgtttgaattttggaggtagaggttgtagtgagttgagattgtgttattgtattgtagtttgtgttataagagtgagattttgttttaaaaataaataaaattgatggaatttgtagattttgtatagatatatgtgtatgttatatatgtatagtttttttttttgtgtattgtttttttttttggtttttgttgtagtttttattttgaaattgaatgtaagttttgttttgattttttgtggttttgggaatttttttgtattttaagttttaatttttttatttttaatatagaggtgtttggagtagttatttttaggggtttatgtaaattgtagagagaataggggagtgtatatgtgaaagtttgtggtatagtggatataagttattagaatgattaaaaataggaatatttttggaattttttaaggtaggagggttttaggaaatggtttgaaattagtaagagatagttttttttatttagatttgaagatggagatgagtttttatgtgtgttatatgtttgggttttgttgtttttatttaaaaggtgattttgaggtttgtgggttgtagattttatatatttttttatttttatttaaaagtaatatgtgttagtgtgtgggtttgtgtgtttttgtaagtggttatgttagagttagtttgtaagttttattgtttgtggattattttagttttgtgttttgggtgtttggttttgtggtagtttgtttggaaggtattattgagttttttttttagttttgtttggggaaggtagatagttgttttagttggggtaaggttagtaaagatattgtttttaggatgattttttttagtggttttatggatgagataggatggtaaatgtttttttttttttttttggtatttttggatttgatttatttagatggaattttttgatttttaggtttgtgtttgtatgtgttatttttgaatgaagggtgtgataatttgattttggttattaatatatatgatttattgattgagaatttatttattgttaggtggtgtatgtgtgtgattgggtggggtgtgggtagtagtggtttgggggtttgttagaaagtttgttgagtgttagatttgttatttggaggtaatttattgttttttaaaggggttttttttttaggttgtgtatatttgttggatgaagaatttgtttatttttttgttttgttttgggattttttgtggtttttgatgggtaggaagttatgagagttgttggggtgagtggtaggaggtgaggtttgtttttttgtttgttttttttttttttggttatagatttgtggtgttagttgtggtattttaagtgttgttttggtgatagattgttatgttttaaatttaggttttgggatttatgttattttggtattggggtgagtttattaagttgtgggttggattagtttggttagggattagtggagttttgtggttttgttgtttattggaggggtatttagtttttaggttaggttttgtttttttttttttagttatttaagtttgaaagttttatttgtttttgtttttttttgtgttttttaaggatggttgttttttagaggttttttagttgggtttttattttggttatatgattttgttttttgaaaattttatttgtttgtagttttaggtagagaagatgtttttttgttgtttttttttttaaaagtgatttgttggttggtgggttggtgttgagtgagtggttattttagatttggttgtgtgtttgtttgtgagggtgagtaataggtttatagagtttttagggggagaggtgttggtggggattattgtgtggtttgagtggatttttaaaataatttttgatttaattttggggtaaaaggagagattgtgaatatttttgaagaaaggaatttgtgtttttagttgttaggggtagtttattttttgagtgaaatgatgaggtttttagagtgattttttttttgggggggatttttgtttttttgtgttagggttagggtgttgttatttaggaaattattttttttttgagatgtaggataaagtagtggttaggggggtggaggagttaggttgtttgagaatgaattttggttttgttatttagaagttgtgtgattttgggtaaattatttattttttttgagttttattttttttttatataaaatggggaaatgatattagttgttttatagggtttttgtgagataaatatgaatatatattagatgtgtatagtttttgatataaagtaagtggtatagatgtgttagtattttgattatgataagtggtttattgatttattaatattttagtaagatttagttgatttattgttaggtagtttgggaggaaaagtataaagtgtggaatggagagggtgttggaagtatgttttattttttttatatattttttgaaggttagtaggatttgaggtaaaaagagaatttttaaagtgttgattaatttattttatttttataaaaatgttttttttttttttgtaatgtttttgaaggggttggggattagtgtgtttaagttgttgtaaaatagattaattatagtagggaaagggtagaattgttattgaaaagattgtttttttaataataatttagtaggttttatttattgggtattgattttgtgtgttttgggttttgtataggttagggaaattgataggtttgtattattattagtgttattattttgtgttatatatgaggatatggagtttttttaagttttatagttgggggtgggagtggatttggagttttttaattttgtgttattttttgttgattgagatttggattttagtgtagagtttttgtttggtggggtaaagaggagggttgaattggtttttttagtaattttgttttgtagtttttgggagtggttagagatttttttatatatttatagggtttatttattgggtaagtatttaggaatttgatgaaaggaggggtgataagaatgagaatttttaggtgtttgttatagagatgagtgttatttgttagggttgagagtgagaagatgttttatttttgaattagtttaggttgagggtgtgagttatgagttgatgtttttagtagtttttgggtttttgttgtgtgtaggttttttgtgttatgttggggttttaaagttaggagttgtggtttttagttgggggtgagtttgtttggtaggagatgtttggtgatgtttggagatatttttggttgttataatggggagagggatagggtagttgttattggtatttagtgggtaggtggttgtgaggattaagtaatttattatatgtaatgtgtttataataatgtttagtatgtaagtttttaatatattttagttgttttttttgtattataattatttttataataattattgatgtaagatttttatttgtttttaagaattttagagtttagagggtagatagatgagtgaatttatagatagattttaatgtgggattttgtgggatttgggagtgtagaagagttgtttgatttagtttggggaaatagggagggtttttaggagggggtggtttaggttaagttatgatggataaatagtggtttgttaggagatgtaaggttgggaggtatggaagggagttttgggtaaggggaatagtatgtgtgtgatatggaggtatagaggtttttgagtagtaatttttgaattttttatttttgtttttattttttttttttttttggtattgatgttttgtatgtaggttaggtattttttatggtaggtgaaatggattttaggtggtttattagtgaggatgttgtatgtgttaagaattattttttagtgttattttttttttgaattagttagaaggagtggagttttaggttaggtatggtggttaatgtttgtaattttagtattttggtaggttgaggtgggtagattatttgaggttaggagtttgagattagtttgattaatatggtgaaattttgtttttattgaaaatataaaaaaattagttgggtatggtagtggttatttgtaattttagttatttaggaggttgaggtaggagaattgtttgaatttgggaggtggaggttgtagtgagttgagattgtattattgtattttagtttggtaatagagtaagattttgttttaaaaaataaaaaataaataaataaaaaaggagtagtgttttagtgaggtattgttgtattattgatatttttttttttaatattggtttttttttttttttgtttttaggttttgattttttggggttttggaaatgttttatattttgattatgttggtggtagtaagaatgtatgatatttggtaaaatttgttaaattttatatttaaaatattgatatttgtgtatatgagttatattgtagaagtattggtgggggtggggttgtataaagttttagatttagagtttttgtttagttattgtgttttgtttgaatttagtaagttttatttttattgtatttttattttattttttatttatggaggtgatattgattttttatttgtagtagtggtgtaaagtttttttttaaaataaaaaaaaaataagtgagtgaatttaaatattagaagtattaagtaaatattttttggtggtatatggatagagtaaagattgtgtaagtggttaaaaaaaaagtaagttttttggaaatttttttgagaatatttggtggttttgagatgaaattaattttatttagtgttgtgtgggtattgtgatgattgtaagaaagttgtttgtgagtgtggtagttgtttaaggagaaatagtgatgaattttagttattgatttagagaaatattttaatgatgtgttatttgtgaaatttattgttaaatatttaggggattgagaattaaatgattattaattatttttatattttttgtttgttggtaaatatttaaagttttgttaagaggaaaaaaaaaaaattgttgtttggattaatgaaaattaatgtaaatgttttaaatatttttgtttagtatattggagttttttgttttttagagtttttagggagtgtgagtgatgtgtgtttttaggattgtgtttttgtggattgtgtatattagttttaagggtgtgtttttgataagatatagtgtagtttttttgatatggttggaatttttgttaagaaattttttgtgttttgtttttttggtttgaagggtagtgaatttttagaatgttgttggttatgggtttgatatttttttttttttagattaaaattttgtgttttgttattttttaggaaggtgtgtgtgtgtgtatgtgtgaatttaaatatatatttatattaaattatagttttataagaattttaggttttatagatgttagttagaaaaattaaaggattttagagttagaagttattaaggaaattgatttagtttaatgttgtttagttataaatgagaaggtgttgaggtttttagtgggtgggggatttttttaaagttatgttgttatttagtggtggagtaggattgtattttttattttttgttttgtaaaatagggttttattattgtatattatgttatgttatttattatttatgaaataaaattaaaaatgttttttttgggagttatatttatttttttatataattatataaattaaaggaagttttttttttgttatgttattgtttttttattttttagtttttttttttggaggatgttattattatttgtgatttttagagaaagtttgtgtattttttagttgtgtgtgtatatttgtttgtgtgtgtatatatgtgtgtgtatatttgtttgtgtgtg

SEQ ID NO: 75 - DNA, 21954 bp, Artificial Sequence
  chemically treated genomic DNA (Homo sapiens)
gagtggttgggtttgtttttgaggttggagtggagatgattgtagttagggtggttttgtttaagttgggttagtagagtaaggttttttttagagggtttgtttttgggataatttggagtttgtttttggggagttatatatgtttttttttattttttgttggagatttggggatgtgaagggggggttttgtgattttggaaaaaaagtaattttttttggtaggtgatattaggtagttgtgttttggggagtttttgtttttttgtgttttttttgatgggggtataggggttggtgtgtgtgtgtgggtatgtagtttattttggggagttgggatttttttttttgtatttggggaagatgaatgttgattattggtttagatattatattatataggtatttttggaggtattttgtggtgttattatgggaagttgtgtggattggggtttttgtgttatagttgaggagttttagtgtttgttaggtgggagttgtatttttggtgaggtgtttttgggagggggtgttatagtttgtggtagtgttggttttttgttttaattagtttgatttttgttgtgttagtattgtggggagtgagtgggttttgtttggttgtggtttggatttggtagttgggttttgtgggtgttttgagttgtggtttgtggtgtggggtgatttttgtgtttggtgttggttttagaattttgtttatggttttttgtgtatatggaggttgttggggattttgatatttgtgtgtttttgattggggtttgttttagtagtgaagatttaggtttttttttgggttgtggttgtttttggtgttttatgggagtgtttggggtagggatttggttagtgatttgtaggatatgaggggtgagttgggagttgatttgtttatggtgttttttttgttatggaggttttttatttattttattttggggttgtggttatgtattataagagtatttttaggtttgagttttttaggggtgggagtaggtagtttgtgagtttgggaaggtttgtggggttttttgtttgttgtggatttagtgtggggttgattggggttggtgagggttggtgaggattggtggggatttgtggggttgagttagtttttgtgaagtttttaagtgaggaatggtgtttgtggttgtgtgttttttgtagttaagttgtagggtttagtaggggtttaggttttgttttttttgtagattttggatttagggttttagtggttttggttggagggaaggtgatgtgtagtgggtgtagatgtagagtgtggggtgttgaatgtgggaaggagtgggtttagtgtgttggtgagagttttaggaaatttgggagagggtggtatttattagttttttttttgagagtaattaggtaaattggggaaggttagaggtgggggatttgtttgagttgggataaaaaattttggagttagggttttttaattttggagatttgttgattttggggtgggtttttgtatttaagttttgagatgggatgattttttaatttttgtttagtttttttttttgtttttgttgttttgttagtatttttgtattttttttttgggttataatttttgtttgtggaatatttgtttgaagggtgtgttagtagaagttttgttttatattattttttttattgttttttttatttaaattgtaggatattatttttggttttatttttatatagtatttggtagtggataaggagtaggtggatttgaatttgaatttgatagttgatgttgtgaagtggatatttgaagtttttggtttggttttagggagtgtttagggaatgtgttaggtagtaattgggtaagtatgagttgtagtttaatttttttttttgtgggaaaatttaagttaggatgtaatgtgaggttttttaaatttttaagatttttgggttagtttaaagagtttttagtaatttgttgttttgttttgagattattattggtttttaagtatttaattatttaatggtagttttttgggtatattgggtagattgataggttttatttaatatttaaatataagtttttggaggaaatttttatttgattttttttttttttatttgttgtttattgttatttattttattaaatggaatttatttaaaatttaaatttataattattaaaaagtagttttattatatatttttgaagatttggttgtgtatgattatttaattatgtagtttaatttttgtgttgtttttatattgttaatttgatggaggagagtagatttgaggattttttaatttttaataaaaaagaagaggattttatggttggggtgaaaaggggttggtgagttatgataatggggtagtatagttttattatgtgtaaaagtatttagatatatggtgatttttttgtaataaaattttattgatgattgtttgaaagttatggtaattttaaggttataaaatttgttataaaatattaagtagttattagtttatttgattttattttaatataaatttttataaaatattttattttgtttttttttataagtggagaaaagaagttgaagaggttaaatatagtggtttattattgaggatttaaaatttgtaatttgatattttgatttttatttttgtaaataaagtagtaaaatttatattttattttttaatgttttgttattgtagaaaagttaatagtgtgtaaatgttattgtagaaaagataataatagttatgttttagttttaattgtttatttttagtatataatttgtgtttaattttggatggagatttttttttttttggaagatttgtaagatatatttaataattattaaagaatatttgttttttgagttatgtaatagaagtttaagaagtaaatggttatatgttgttatgtgatttgaagagttgtttaaaatatttaattagtatttatagttattgagaggttagatgattaattattattttttgttatttttagttatgagtttaaagaaaggtagttgttttgagattggtatgtataattatattatagaaaataatttaaattgatgttttaagaaagttttaggagataaattggagtttgttaaaattattatttttggtttaattgtatgagtggatttaaattatggattagagaatagttatagaatattgataattttgagtggttttttattgttttaaattttattttggattggttgaagtttgtgtttttttaatgttgtgtagttaaggttaatttatttgtttttggggatttgtgagtaagtatagatggtaaaggttgattttgtgttagttgtatggtgatttttttaaaatatgtaaaagtttggatatatttttttatggattgtttaaaatataagttttaagattgatttaggtatatatgtatttatgatgggtttaggaatttagatgaagaaagttaattttttaggattttgttggaattttttttggtaatgttatgtttagttttttggtgtgtttttaagtattttatggaattttaatgagaaaataatattttaaaaattaaaattttatgtaaaatgttgtttttttttagggagtgtatgggtgtagagtgtgtgtgtgtgaggggggtgagagagagagaagaaagagagagaaagaaaaagaaagagagaaagaaaaagaaagaaagaaagaaaaagaaagagagaaagaattttagagaaaggaatagggatgaagttaagggaagagagaagtattggataaagtattataaaaagtaaatttttttagtgtttataattttttttagttggttggtatagtttgtagtaatttttattattgttttttaatgttaggtttttagatataagtgataatatgtattaaaataaagattttgtgtttttttaagttagtattgatttttagggaggatagggaagaaagggtttatggatttataatgtagtttataggttgaatatatatttttagtagatttaagaagtaaataaggggtttaaatttagttttttgagtttgatatgtttttgaaaattttatattgtgggttatttttagagataagttgataaattttttttataaatgaattgattaaatgtattgtgatatatatatatatgtaaatttgttggtaatatttgttgtagtaaaaatagtagtgaatttaatttataatgtttatatttttttgttattaattttagtatttatttgggtttttttagatgtttggagtggtgggagtggagtaaggtaagggagaaaaaatgttttttttttaatttttgataaaaataatttttttttttttttttatttttttttttaaaatattgttttttatttaagaattagttatttagattttttattttgatttttattgttgttatagtaatatataatgatttttattttgttttatttaagtattatatttattagaaagttgtggttattaaagaagtatttatttggatttatttttttgaattattttttttatattatattttggggaaggtatggaaatgatttgagttgatttttaaagtgttttttatgttaaaaaattataagggatagtatattatgtatatattttttttttttatattttgttttgtttaaagatattagaaaatgtttatgagatattatgtttttttttaaatatttttttgagttatttggttaattgaggtttagttgtataatgagaagtatgtttttaggagggttttaaaatatatgtttgggattttttttggatagttgggtgatagagttgtgaaattttaaattatgttttgagttttggtgatatgtttaggttgtttagttttgtttttattatttttattgatataaaaaatgtttttatagaggaaaaaaagtgtagtttttatgtagtgatatttaagtgtatgttatttattttttttataaaatttaatgtatattttgttttaagggtatatatttttttatgagattaattgttttaatagaaataatgatgttttttatgtatttaatatttttattttttaaaatttttatgtgttttagtagttatatgatgaaatatatagattatgtgtatgttgtggttagaagttatggtttaatttatatataattttattaggttaattttttgttttttgtgtgtgtgtgtatatgtgtgtgtatatatatatatgttttgatgtaagagaaatagaaagttttaagtaattttgttttatagttaaaatattatagataagtttggttgtaaaagaaaatttatatttttagttattttaaaattgaaagaagaggtagggaagattttttttggaagttataatttttatatgagttatgtttgaatttttagaatataatttaaataatatatttttttattgattgtattttttttttttgggaaaattggatggataaatgttaaattttaaaataaaaattggggaagggttgaagaaaatatatttatttatattaattattattgaagaattttattttgtattagagttggagaaatgtatagtattgatttagaatgttatagttggatttagagagttttaggtatttggaaaatttttgaggtatttatggtgttttttttttgttttgaattgtttttggttatttataagttaatttgttttttttaagttttaaatttatttgttaatgtatgtagtatagtatttttatttagtaagaaagtgttaaaatttattggtatgaaatatttaaattgtaaatggaaaatttgtttagttaggtggtgttttagtattttttttttaaaatatagtagtagtagtgtttggttgttggaattggttgttggttttgttggggaggtttgtaaatgtattatgtattatatagtttgggaagtagggtgatttggatagattaaaagaattttgatttttttatgttttgatttttagggatttaatttttagttttaaattggtattatgaaggttttttatatggagtaatgggattattatttttttttttagtgaaaggggtgtttttaagaatggaaatatgtggtagggtagaatttaattttagaggaattgaatatgaattatttaggtaataaaaattgttaagggaatttgtgttgttagtttgttagaatattagatttatatttttggttttgtaggaaggtgatatggggttttttaaaggttttttgtggttatgattttggttttttatttttttaaggagtggtttattggttagttaatgtattgggttggtattttgattttgtaggaaatagaattagtttttttttttaattttttatatttattttaggagtttgataagaatggtagttttagtggtatggttgtattatgtataggatattggtttagtatttttggtgttaatttttggttttgtaatttttttttttttttttgtagttattaaatttatagtttgaatatggtatagaaatagaatttaaattgtagtattttaatgtgtaagaattgtagtaaatagaattgtaggaattggaataatatatgaaggattagtattgtttaaaaatttttttttatttttttaaattttttgtttaagagatttttttgttttttttgtttattatgtttttttttgttaattagtttgatttttattaaatgttttgttagtaatatgatttttattaaatgtattattaaaatggattatgtaatgatattatgaatttaaatatttttaagatttaaaaatgtgtaggtagttttattgaataaataatattttataaattattttttatttttgtgtaaaggatagtgtatttgttgaagaaaattagtaatatttgtttgatttttgtttttattaaaaaaaatgggttaatttatattaatttaaaaatattttattgatgaaaaatgtgaattatatgtaagtagtttttttttttttttttttgttagaaaaaaatataatagtttgtatttgttggtaaaattggtttattttgtaaagatggtattgtgttttattttttttggtttattaaagagttaaatatttttgaaattatatttattttatttttatattttttttttttagtttttgtgtgtttattgaaaatattgttgggttttttaataatttttttagaattgttttttaattgtgtttatggagaggtggttatattttgtttttttagtggtttagatatgtagtttgtttagaaagttatagttgttgtggaggaggtaagaggttagtttttttgttggttttggtgagggtaaaatttttaggtaggaggagtattgattggtaaagggaagaggaaagggtttgttttggattttataaatttgttttttggagtaaatagtttgtaggtagaggggtttattagagtttgtttagtttttgggagggttaattttagttagtaagaagatttgaggtgtaggatttttgtgtaggaggttgtaggaatgtttttgttagttgtaaggtttttgttggtttgtagagtttttgtgatttttgttaagatgtgaatagtaaggtttttgtatggattgtagtttttgtttgaaatttgaaaatattaatttgggattttgtagttttggtttttgggtttgttttggaggtgtatttttaatttttatggaatgaattttgtggttaaaatgtatttttttaaggtagtaaaagtgatttttgtatttaataatttttgggttttttttttttttgattattattttttgtagggtgtgttgaaatttttttattgttattgttttttataaatgaaatgatttatttatttgttgtttgtagggaatgaaaggagttgattttgattttaagatgtattttaaagaaagaaaatgtaattgtagtttggattttgtggaggaaggttaattgattttattatgtgtatttttgagttatttgggtttagttagttgtgttaattatgggttttaattttattgtaatttggtattttttggtttgtttttattatagtggttttaaaaagaaatatatataggtatattttagaatgaatttttgggaaggtaaaggtagatttttttggtgtttgagttgatgttttgagagtgtgttgagagttttgggtatgttttggtatttttggaaataaattgtagttaagagtatggtttttttggttttttttttgtttttttgtgtgttgtttggttgtgggatttttggaatatgttgtgtattgtttgagtggttgtggattttattttgatgttttggatagttggggttaggaggagatgagtaggtagttttttgtttttatttagttagttgtgatttttgtggtgtggatttttggttagtagtgaggaggataaggttgtagattttttttgttgtgggttttgggtttggttttgggtggtattttgttttttaaagtgtggaggtgggtagaagagtgtttatttttagtgtagatatttgaggtatgggggtttttttgggggttttagtgtgagttgtttttgtagattagggaaatggagagaataataatggggatatggtggaatttagatttttttttgttaattaataatatgattttgtttagtttaagtgttttttgtgtttttatttaatgttttttgtaaaatgggaattagaataatatttttttggtatggttgttgtgtttgatgtgagtttttaataaatggtaggatgaattggagaagaatgggtttattattttttatatttttttttgtagagtttttttgttgtttttagtttttttgttttgatgtaaggatagtttataattagtgtttttgagtagtttttgggggttgtaagagaatttgtttggtagggtatagaagatgggtttttggtgaattgtgaaaagatatgattgggttttttttggagtatggtggagaatgatgtggagttttggggttaatggagagttgagggtgtagagggatttgaaagggggaattaaaaatattgggttttgaaattttgtggatttttaaaggtggtttttaattttgttaaaaattatagtgggtgtgtgatttaatttggtttttataggtggtgttgtgataaggtgtggtggttgggagaggtggttgggggatttgaagattgtgggaaattttttgtgattttgatgttaatttgttgtttttagtttttgttttttgtttttgagggattagttaggattgtgtaatattagtttttgtttttggagttggtatgggggttggtgggtggtgggatgaatttggggaaggtgataggttggaaatgtagttttttgattttgtagtgtattaattttttattgttttgtttgttgtttaggtgtgaggatttgttagatgttataggattgggggtgatttgtaagggtattatgttatttagaggaaatgtgtagtgagtgagttttgggttattgaaaatgggagaatgtttgagttggttaagatgattttggtttgtgagttgatttagattttttggaagttagaaattgggtttagagtgggttggtttttttgttagtagtttgggtttagttgaagtttggggtttagagggtagatgtttggttttgattagagtatagtgggttgggtttggtagtttgtaggtaatttggattttgtaataaagttgtatttaatataatttagattatagtgggagtttttgaagggttttatgtgagttttgaaattagagtttagaggtgtggtttggtttttgtttattttttttagatagtatttaggttaataaggtttttgaaaggaggtagttttaaagtttttaggttgatatttgagggtagggttttaaatagttgtgtttgaagaattggtaattttgttttttttatatgtagttgtattttttttgagtgttgtagttgatggttgtatagtgattatggattgtgttttttttatgaagttgtgtaatttttgttaatgttgtaattttggtaagatgaaatttttttttttttggttagattagtttagtttttttttagggatttttttgtttttttttatttttttttatttttaggttgtttttttttttttttgttgggatttgatttttgtttgtttttgtaattttgtagtttggagttttgttttgtgtattaaaatatgtttttttttatttgtagatttaataaataaatgtaattatattatatggagttttatattgtttttttgaaagtaattttgttgttgaaaattgaaaaatgggtgtaatttgtttttagaaagtaatgttagggttatggtaattttttgggttgttatttatttttattttaaagtttttaggaaagatttgtttatatgtttggaaaatttttaaatgtgtgaatattagtaattttgtttgtttttaatgtgtggggtaagggggggtggggaataattattgagtgatgttaatatggggaaattgaaaagaaatgttgattgtttttattgtaatagaaggagtgagtaaatagaaaaattaattttgggtgattggaaataggtaggtggagaattaaaagtgggttttagatagtaataggttttttttttgtttttgtaaggagaaagtgggtgatgagtgtttgtagtttgtggggttgattttattttttgtagggttttggttgtgttgttgttggattgtagaatgttgggatgtatttttgagtttgggtttgatttaatttgttgttattttagttatttagtggagttgtggagagatttttgaattgtgaggttttttgatgagaaggtggagaggttgttgggttattttttgagtattttttggttgagttttgtttttttttgtgtgtttgtggtttttttttgggttagtgtgtttgtagtttttttaagtttaggttgtaggttagtgtgtgggtgttttttgttttttttttttattagaggatttttgagggttgtttttatttttaatttttgtgattgttttttttagttgttatttttttttgtagtgtagattttgtaggggttagtggtttagggtggatttttttttgttttgggtgtggggtgagtttttggttgttatttgttgttgtagttttagggaaatttagttggttgtttattttgtaagatggggatatagtagagggttgagttttggagaagttgggtttgtttttttttttgtattgtgtgtaatgttttaattgattttgaagggttttgtttttattgtatttgtttttagatggttagaagttaatgtattatgaaaattttagttttggattttggattttggttgttttataatttttgtaatttttttgagtggataagaggtgggtattgttgtttgggttttgtttggggggggggggttttgtttttagtagggggtaagttggaggaattagttttttaatattttttgttagttttgtttgttataattgtaatttggaatagaataattttttttttgtgtatatgtatttttaatttttgttttatttttttatttatagttattattgatttgtagatttggaggagtaggtttttgggggttggtttaggttggggatatagggaggggtttttgtgttttgtataatttgtagtgtttgggtttgattttggtagtttttgggtatagtttgttgggttagatttttgttgtttttttgtgtttttttgtgggttgttttagtgttgggaagggggtgttgtaggtgattgtttgtggtattgggatggttgatagatttatggagattttatagtatttggttggggtttgtgagggtagggtggagtttggttgatttgatgttggggtttaaagtttttttagttatatgtttgggttgagttgtttttagagtttttggtttttgttttttttgggtgggtgtatataaggatttggttagtgttgagtgtattggttttttttatttagtgtagtttttttttttatatttttggtttggtttttagttttttattgagtaaatatttatttagagagtgagttgttttttggaggaggttttgatgtggttagggaaaggttttttggtttttttttggtttgagttagttgtaggttttattggtgttttggttttggttttaaatttttttttttagttgaaatttttttgatttttttgagattttttgagtttagagtgagtagtgtaattaggtggtagattttagttgatttttgtttttgttttaggttttgtatttttatatttattgggattgattagattttagtgttttttttttttttttttttattttttttttttgttttagatttgttgttttttggttggttttagtgggttgttgattattttgttttagtatttggtttgtgttttgggaaggttttagtattatttttttttgttgggattttgttgattttgtttgtagttttggttttttttgtttttagagtggggtttttggtttgttgtggatatttagtggtttaaaatatttaaaattgattttttttgtgtttttgagaatgttaagagtatttagtatttgtaattgttggtatgagtggggtttgtggggagttgttagagttgtggataggttttttgtttattgagttgttatttttggtatgtttaggggatttgtagtagttgaggttatatggttatagttaagtttagtaggtggaaagggagagatggtattgaatttatgtgagaattgggaagatgtgtggtagttgaaggagttggtaggaataagagggagttgtatgttatttttatataattagagttttaaattatattagtttttgaattagtttaggttggtgttgtagaattgttaaagtttttgtagagtttttagattttttgtgggatatgaggttttgtttgtttgtatgtgaatatttttgtatttgtttagtagttttgtagattgtaaattttttttgggtgtatggaagtagagtagatttggtgtagaggttgatatttattgtttgtttgtgaggggggaggaggatttttttttggttaagttgttgggtatgtttatttttttttgtaagtttaaggtagagttataagtttttttatgatgtggtaaagttttaattaatttatttattagttttaagaaggagttgttgtttttaaaatttttagatttttgaaggttttttttgtgtaaaaatgttaggtggtgttatatgatgttatttaataggtattggaggttagattaggttgaaattgttattaagttaaattttaagaagattttaaatatttgaaattaattaataaaaagggataagtttaagtatgtttagttgtgggattttttttaagattttgattttaaagagtggtgttttagtttatttttattttttatattttttattttgttaggtaattttgaatttagagtgtattttaattatagaagtgggaatttggagatttgtttttttgtagaagtatggttgattatagtttttttttgggtttttgtaatttattgatttgagatttgggattagttagtttttttgggtgtagattgtagttatatatatttttggggattgttggggaagtagtttgaattttgtgtgtataaggagttttttggattgttaagtagtagtaatagagtttatgattttaagtagtataaatttttaaatttatgaaaatatttttttttttgtttattattttgatttatattttttataattttaattgtaaatattaataattttggttgtaaaaaagtatatggtatattttagattagatttatagtgaataaaagtgaaaatttagaagtaggtagaatgatagggtttttggagtttaatggaagatgagggaattatatttatgtgtagtgttggtgtttattgttttgggattaagttttttttatatttaaataaaatttttttgagagggtttgttggtttggagaatttttataaatgttgttattgagggttaggggtttaggatagtggttgaatgtggtagagttttgggttttgtagtgagtgttttatgtattggtaattggttgatttggggttgtgtgttagtgttagttgtttgtggtttagttttttgtatatggtgtggtttgtgttttgagtttgtgtggttagtggttggttggtttatttggattggggggttgttgtaggaagttggtggtaggaggaatttttttggttttaatagtggtttttatttgtggtttgggttttttgtaattttttggtttttttggttggtttatttttttatatttgtgtttttgttatttggtatggattgaagtgaggtagaattggtaggtgatatagatttttttttgatagtttttagaggtttgtatgatagattttgttaagataatttttttatttttgtgtatggtggtgtttgttttttatttatagttttaattttaattttgagatgtttattgttttttggaggaggtttttttgggttttttttttttttgagttatttatatttagattaaatgtttttatttgtttatttagtattttattagtttgattttgttgtttttttgtgttgtttttgggaagatgttaaatatttatttttattgtatttagttatttaggtggggagttagtttgaaagagatagtggaaggagttttttggattgtgttgttgtttattgatttgtattaattattatgtagtttgtttttggatttgttttttttagggtgtgtttttagtgagtgatagatggagttgttttgttttgtttagtttagtttatgttgttgtttagattgaaatgtagaatttaagttttttttattggggtatagatttttttttattttttttttttgtttttttgttttttttttttgggaagaagtggaggtgttggtggttggttgggatagtaataggttgggttattgaggtggtgtggaaagtttttgtttgggagtgtggaattggggttgggttggtgtattgtttggagtaatgggtgagtggtggtgggggattttgttagagttgggaagggagggagggagtgagtgggtaagggagggagggagggagggagtgtgagggtgtgtgttattaggtgtttatattttttattgattttgtttgtgtttttataagttgtaggaatatgttaagggttagtggtgtatagtagtttaatgtgaatgttggttattgggtggttgttgatgttattttttgattttaagagaagggagttgtggtattagtgagttttttagtttgagtagtaaattaagttttgttttatatgtgtgtatatatgtaaataaaataggaaaagaaaagaaaagaaaataaataataataaataaaatattttttagttttttttagattttgtttaattggttgggtttttagaaggaatgttggggatgggatgggtggagagagggagtggtttaaggattttagtgaggagtaggtgagaaggagtatgtttaggtgttaagattgatttttttttttgttttgggagatttttgaatgtttggagaggtttggtattttattattttatttggttgtaggggtttttggtatggtaggaatgagggagggggtttgattggatagtgatggtttggggttgtttggttatgtttagggattatatggtttggggatagttttagtagttagtaggggatgggtgtgtttgtttagtttttggatgtgtagggaggtttagtggtaggtagttgttttaagtagtgggtgtgtgtttttgtgtgttgtgtgtttattttgtagagttagtttttggggaggtgaattagttgggaggagtgtttgtgaatgggaggttgttgtttaatgttatttggttttgtattgtggaattggtttaattgggtatttgattgtgtgatattagttgttagttatgggttttgtatggttgtgttagtaagattttggtgtgatataatgagatgggtttgattttgttaggagttattgggggtagtaagttttgggttattatttttattgtggtgaaatatatttggatttataagtagagagattttggtatttttgtttgggagatttgggattgtttgttggtggatggtgtgtgtgataagtataatgtgttttttgtgagttttattagttgtattttgtgtaataagattggtaatttggtttagtagggttattatgatttatataagtagtattagttgatgttgtagttagtgttgttttataattatatttatttgtattttagttttattatggtggtggttgttaaggtgtttatgttatttggggtgtttgttatttttggtttggtggttatgttgtgtatttggttttttttgtattttgttattgatattttgggtatttgttttattattgattaaggtaggggtttagaggttgggtgtgtggatgtgtagtgtttgtttttgtatttttgtggaggttttagtatttgtagttttagggatattgttttttttattatttgaggtttttttttttggaaatgtaaggagtttttttagggggtgttttgattttattaatttgaaatttatgtttttggtttttttgttatatatagttttttgttttattttaaattattagatttataatatttttttatttttaatatatggtttgtattttttatttttttttgttttttgtgttgaggtagttttagtttggtttgtttatttggagagtgtggttggggttggatttggggtgtagtttgggaggtttgagtttgtttggggttgttggttgtagattttgttgtgggtagagtagtttgtttggggattattatggttgggagaagtttggttgggaggagtttagtatgttttggaaattgaagtattttttgattttggtaattaggttaaatttgtttaggtaggaagtttaaatgttatttaattggttttgtttttatgttttattttattttttttggaaatggaggttttgaagttattattagtaatttgtatgtaatttatttttagatgaagttatatttatattttttttttttttttttttttttttatttattttttaatttaatagattttattgtatatattttaggaagggaagtggtattagttattgtagtgatggagataaaatgtaggtaattttatgttgtttttttattgttttttttagttttttttgagtttgttatttttttttggggtttttgggtttttgggtttttgagaatgtaagtggatatttatttagtttttgtatgttttaagtagtgttattttattgtttttttttttttttatttttgattttgtttagttttaagtgttttttttgttttgttagaaggattttttgagtttttttgtttagtttggtttttgtaggagatttgagtttgtttttttttattgagtttttttttttttttttaaggtgttaattttttttttggtagggagaaaagaaagtttgaatgatttagatgtagaatttaaataatgtgtagatagtttatttttttaattttttagtttaaagttttaaaagtgtagaggaaaaattaaataggaaagggggaaatagtttttttaattattttttgttttttttggttgttattatattggtataattatttttttaagtaattaaagtagggttttgattttttatttttttgttttttgattgtaagtttataagagtttagttttgttttatttggagttatttggagttatagttggagagagtttgtttttgatttataggataaattgattttattgatatttaaaggaagtttttgtttatgggaaagtgtgagattagtagaaatgggggtttatagggggattttaattttttaagataattttaagtttgtgtttattgattgttttttgtttgggaaggtaaagatagataggtagttttggattaaaatatagttttttggtgtaaatgggatttaatttaatttttgggggtggtagaggaggagatatagtgaaaaaaaaaaaaaaaaaaaaaggttgatagagtttaaaagaaaattttttttgtttagggattttattattagagtaaatgttagttgggaaagtattggagaatggaaaggagtaatttttttttttagatattattgtgattttggatgttagttttaaataatttagtttgtgatatatttgtgattataaaaatgattatttttataaaaatgtttatttttttaaagtattgtgttagatggaagtgtttaaaattaagttataatggttttgttaaattatttttttatttataggatttaaagataaatatatattgtttgtagtttttatatatttttttgaaattatatttggttattgaaaaatgttaataatttaatatttttaattttaggtattatagtaattattttatattatataattttttttgtatttttattaagaatagaaagaataattgatggtattatattttaatatttaattttatttttatttttttaatttattttatttttttttttttgtatatatattttttaaatttttttaggaaaattttgttattaatatttatggtatgtatagtggtaattgtaagatttatttttaagttatatgtatatattatatatgtaatgtgtagaggtagtgtattaaggggagttttatgtatatataaagtagaaatttgtgtatgtatattttgtattgtattgtgggaataatttagttatttgtttgtaaaggatagtgtaggtttttttgttttttattgatataagtattagatttttatagtgtagtgagtattagtgtaggtatttttaggttagatgtttttttttttttttttagttagttttattgttaaattgttgttaatttttagttggttttgggttaagaatgaggaggtggagaatggtatgtgtagttttaagggttttttttttgatttaggttttttttatttttttgttttgggagagtaaaggggtgaagggaaattaaaaattggttgaaaaagaaaaaagtgtttttttttaggtgtgggttagagaatttggaaaggtttattttgaggggagtaaaattttattaggttttgggttggaagtataggaggttgtggttgggtttagtgtttttgggaggttaagggtagggagttgatttaaggtttaagttttttagttttttgttgtgggtttgggttttgttttaagagtggggtgtgtgggttgggtttttggtttgatatttttttttttttttattagtgagtgatagttttttttattatagttttaaggtggaggagtggagtagtttgggttgtaataatttttttgttgttgttttgtatgtggtgaatgggttggagaagggagttttggagtaggaagttaagtatggttaggtgaggaggtgagggttaggttaggtgggttgtgtggtggtggggatttaggtgatggaatattttgtgatgggtttttttttgagttttttgtgagagaagtttaggttggtgtttttttgttgttatgagttagattttttgtggattggggtgaagtagaggtttgagttttggaaggtggagttggggttttgatttttgttaggggttgggagtgtttgttagggtgttgggggtttggggtggtagttttttggggtgaggttttgggaagtgtttttaggtttgttggtttttgggagtttggggaggtggtttttgaagtttttttggtggtttttgttgggggtagagttaattaaagaaggtgtttttgaagggttgagtggagtagttttggggttttagagttgtgtttttatgtttgtgaaatgtgtgttttgggttttggttttatggtgtgattgtggttgtggggtttttatgtttggattttttttttggtggtttttggataaatatgtttggttaattttgtggagaggggtatttagataaatgtaataaagttattatttttttgattaaaggttatattgtaattttttaaggaagttagtgagaaaattttaaattatatggattggttgtggattgtttaatttttttttttttttgttttttttttatgtttttaaaggaaaatttaaaatatttgtgtttttattttttttttgagaaaagttaaataattattataataaaagttttagatttaagtttaaatttattattgttttggagttaagagtttaaaatttttaaaaaattggattttaaggtaatgtaaggtttttttagtagattttagtaggtttgtaaattttttaattttaaatttaattttaaagttttaagttatttagttttttttttattattttgaagatttaaaatttttaatgtttttttgtttgttaaaattagtttttaaaattaagtggaatttgttttttttatttatttgaaaaaatattttagttattattttttgtaataaattttatttttattttttttttttttttttattttgttgaaatagaattagaatatatattagtggttttttaatggtaaataatatagaaaatagtaaggaaagagagtttttttttttagtttgtttttattgtgaagaatgttaatgagaaatgataaggaagtttgttatttttttttattaaatgatttatttttaatttgtaatttgtaaagaaaaggtagaatagtataatggttaggagttttgatttttggttgtatgattttttaggaaaatatttaatttttagtttttatttttttatttttaaaatagggaaatgatatttttaatttagagatgttatgagtatttaatgagataatgtaattatatggtatatagtaagtatttattaagtattgtttgtggttttaagtggtagttaaaaagatatgtgtaaaagtaagtaatatttattagagtatattttgttttgagagattatagttaaaaagttttaagagattttgttataaataatagaaagagtgtatataaagtatttattatagaagtaagtatttaataggtgtttagtgttttttattaggttattattgattggaataatattgtgaagtatagagttgaaaaagtttttaatttttatatgttattgatgaatttagtttatatattaagtagttataattttaaaaaaaattttttatatttattatttatttatttattttgagatggagtttagttttgttgttaggttggagtgtagtggtgtgatttttatttattgtagtttttgttttttgggtttaagtggtttttttgttttagttttttgagtagttgggattataggtatgtgttgttatatttatttaatttttgtgtttttagtagagagagggttttattatgttggtttggttggttttgattttttgattttgtgatttatttattttggttttttaaagtgttgggattataggtgtgagttattgtgttggttagtaatt

SEQ ID NO: 76 - DNA, 21954 bp, Artificial Sequence
  chemically treated genomic DNA (Homo sapiens)
aattattggttggtatggtggtttatgtttgtaattttagtattttgggaggttgaggtgggtggattatgaggttaggagattaagattagttaggttaatatggtgaaattttttttttattaaaaatataaaaattaggtgggtgtggtggtgtgtgtttgtaattttagttatttaggaggttgaggtaggagaattgtttgaatttgggaggtagaggttgtaataagtagagattgtgttattgtattttaatttggtgatagagttagattttgttttaaaataaataaataaataataagtataaagggttttttttgggattatgattgtttgatatataaattgggtttattaatgatatgtgggaattagaaatttttttaattttatattttataatgttattttaattaatgatgatttaataaaaagtattgagtgtttattaaatgtttgtttttatggtaggtgttttatatatattttttttattgtttgtaataaaattttttgaagttttttgattatggttttttagaataaagtatattttgataaatattatttatttttatatgtgtttttttaattgttatttagaattatagataatatttaataaatgtttattatgtgttatatggttgtattattttattgaatatttataatatttttgggttgggaatattatttttttgttttaaagatgaagaaatagagattaaaaattaaatatttttttaagaagttgtatagttagagattggagtttttaattattgtattattttgttttttttttgtaaattatgaattaagggtgggttgtttagtaaaagaaaatgataaatttttttattattttttattgatattttttatagtagaaatagattaaggaaaagggttttttttttttgttattttttgtgttatttgttattggagagttattaatatgtattttgattttattttaataaaataagagagggaagaggaagtggaaatgggatttgttatagaaaataatgattaagatgtttttttaagtgaataagaggaataaattttatttaattttaaaagttgattttgatagataaaaaagtattaaaaattttaagtttttaaaataataaaaggaaaattgaatagtttgaggttttggaattgagtttgggattaagagatttgtaaatttattggggtttgttggggaaattttatattgttttaaggtttggttttttgagagttttgaatttttgattttaggatggtgatgaatttagatttaaatttggggtttttgttgtggtggttgtttagttttttttggggggaaaataaaaatatgagtgttttaaatttttttttggagatatgagggagggatggagggaaagaaaaattaaatggtttatagttagtttgtataatttgaggtttttttattaatttttttgggagattataatgtgatttttagttgagaaaatggtagttttgttatgtttatttgggtgtttttttttgtaggattggttaagtgtgtttgtttgagagttattggagagaaagtttgaatgtgaggattttgtagttgtagttgtattgtggggttgagatttggggtgtgtgttttgtgggtgtgaaggtgtggttttgaggttttagggttgttttgtttggttttttagaagtgttttttttggttaattttatttttaatgagagttgttgaaagggttttgggagttgtttttttaagtttttggaggttgataggtttggaggtgttttttagagttttgttttggggagttgttgttttagatttttagtgttttgatgagtgtttttggtttttggtgggggttgaggttttagttttgttttttaaggtttaggtttttgttttgttttagtttatgaaggatttggtttgtagtagtaaagggatgttagtttgggttttttttgtgggaagtttagaaagggatttattataaagtgttttattgtttaaatttttgttgttatgtggtttatttggtttgatttttgtttttttatttgattgtatttggttttttgttttagggtttttttttttaatttgtttattgtgtgtggggtggtggtggggaagttgttgtggtttaggttgttttatttttttattttggggttgtggtagggggagttgttgtttattgatggagagaagagagggtgttaggttggaggtttagtttgtgtgttttatttttgagatgggatttaaatttgtgatggagagttggagggtttagattttgggttggttttttgtttttggttttttgagggtgttgggtttagttgtgattttttgtgtttttagtttagggtttggtgaagttttattttttttagagtaggtttttttaaattttttgatttatgtttgagggaagatattttttttttttttaattggtttttgatttttttttgtttttttgtttttttagggtaaaggagtggaagaaatttaaattggagaaggaatttttaaggttgtatgtgttgttttttatttttttatttttaatttaaggttgattgggggttgataataatttggtagtggggttggttgaaaagaaagagaggagtgtttgatttaagggtgtttgtattggtgtttattgtattgtggggatttggtatttatgttaatagagaataaaaagatttgtattgttttttgtaaataaataattaaattatttttatgatatagtgtaaaatatatatgtatagatttttgttttgtgtgtgtatagggttttttttgatatattatttttatatattatatatgtgatatgtgtatatgatttaaaaataaattttgtaattattattatatatgttatgggtgttagtggtagggtttttttgaaagagtttaaaaaatgtatatataagaaagagaaaatgaaataggttaagaaaatgaaagtaaaattaagtgttaaggtgtaatgttattagttattttttttgtttttggtggagatgtaaagaaaattgtatggtgtaaagtaattattataatatttggggttgagaatattgaattattggtattttttagtgattaggtatagttttaaagagatatgtgaaggttataaataatgtatgtttgtttttgggttttatgggtggaggagtggtttggtaaagttattgtaatttgattttaaatatttttatttaatatagtgttttaaaagagtgagtatttttgtagaaatgattatttttataattataaatgtgttataaattgggttgtttaaagttggtatttaaaattataataatatttgaaaggaaaagttgtttttttttattttttaatatttttttaattgatatttgttttgatggtaggatttttaggtaggaaaagtttttttttaaattttgttagttttttttttttttttttttttttattatgtttttttttttattatttttaagaattagattgagttttatttgtattaggaaattgtgttttggtttagaattgtttgtttgtttttgtttttttagataaaaggtagttggtgggtataagtttgaagttattttaagaaattgagatttttttgtgagtttttatttttgttgattttatatttttttatgaataggggttttttttaaatgttagtgaggttagtttattttataaattaagggtaaattttttttaattatggttttaagtagttttaaataagataaaattgggtttttgtaaatttgtagttagaaaataagaagatgagaaattagagttttgttttaattatttaaaaagataattgtgttaatgtggtggtaattaagaaaggtaggaagtaattaaagaaattattttttttttttttatttaattttttttttatatttttaaaattttaggttgagaaattaagaaagtggattatttatatattatttaaattttgtatttaggttatttagatttttttttttttttattaagaaaaaagttaatgttttaaaaaaaaaaaaaaaaatttagtaaaagaaaataaatttaggttttttgtggaagttggattgggtaggagggtttggggaatttttttgataaggtagaaaggatgtttaggattaggtaaggttaggggtgagaaaggaaagaaatagtggggtggtattgtttaaaatatgtaggaattagatagatatttatttgtatttttggggatttggggatttggggattttaaaggaaagtggtaggtttagggaaaattgaaaagaatagtaaaaggatagtatggaattgtttgtattttatttttattattgtagtggttgatgttatttttttttttaagatatatatagtgaagtttgttaagttagaaagtgaatggagagagaaagagagagagagagaatgtgaatatgattttgtttgggaatgagttatatgtaagttattagtagtaattttgggatttttatttttgaggaaaatgaagtgaagtataagaatgaaattaattaggtgatatttgaattttttgtttgagtaaatttggtttgattattagaattggagaatattttaatttttaaggtgtgttggattttttttggttagattttttttggttgtagtgatttttaagtaagttgttttgtttatagtggagtttgtagttggtagttttaagtaggtttgggttttttgggttgtgttttaagtttagttttggttgtattttttaagtgagtaagttgggttgaggttgttttggtgtgagaggtgggggagggtggaaaatgtgaattatgtgttggggatggggggatgttatgggtttggtagtttgagatgaggtagaagattgtgtgtggtaaggaaattaggggtatgagttttaagttaatgagattagaatattttttaggaagattttttatgtttttaaaggaaaaagttttaggtggtgggaaagatagtgtttttgaggttgtagatattgggatttttgtgagagtgtgggggtagatgttgtatatttatatgtttagtttttgagtttttattttggttggtgatggagtggatgtttaggatgttggtgatggagtgtgaggagggttaggtgtgtggtatggttattgaattggggatggtaggtattttgggtggtgtgggtattttggtggttgttgttgtgatagggttggggtatgagtagatgtggttgtagggtagtgttggttgtggtgttggttggtgttgtttgtatgagttgtaatgattttgttgggttaagttgttgattttgttgtgtagaatgtggttgatggagtttatggagggtatattgtatttgttgtatatgttgtttgttagtaggtggttttggattttttaggtgaagatgttggggtttttttgtttgtaggtttggatgtgttttattatggtgggggtagtgatttggggtttgttgtttttgatggtttttggtaagattgagtttgttttgttgtattgtgttaggattttgttgatgtagttgtgtgagatttgtagttggtggttgatgttatatggttggatgtttagttgggttagttttatgatgtgaagttggatggtgttgggtagtggttttttgtttatgaatattttttttagttggtttatttttttgaaggttggttttgtaaaatgaatatatagtgtgtagggatgtgtatttgttgtttgggatagttgtttgttattgggtttttttatgtatttggggattgggtgaatgtatttgttttttattaattattggggttgtttttaaattatatggtttttgaatatagttgaatggttttaaattgttattgtttaattggatttttttttttatttttgttgtgttggaggtttttatggttaagtaaagtggtgagatgttgggtttttttgagtgtttaaaagttttttgaagtagggggagaaattggttttgatgtttgaatgtgtttttttttgtttgttttttattaaagtttttgagttgttttttttttttatttattttatttttagtgttttttttggagatttggttagttaaataaagtttaggggaagttagagggtgttttatttgttgttgtttgttttttttttttttttttttttgttttgtttgtatgtgtgtgtgtgtgtgaaataaaatttggtttgttatttgggttgaggggtttgttgatgttatagttttttttttttaaaattagaaaatggtattaatagttatttagtagttagtgtttatattgaattgttgtgtgttgttgatttttagtgtgtttttataatttgtaggaatatgagtaaagttaatagagaatgtgagtgtttagtggtgtgtgtttttgtgtttttttttttttttttttttttgtttgtttgttttttttttttttttttggttttgatagagttttttgttgttatttatttattgttttgagtagtatattaatttggttttagttttgtatttttagatagaaattttttgtattgttttagtggtttggtttgttgttattttggttgattgttggtgtttttgtttttttttaggaggaggaggtgagagggtaaaaggaagaagtaaaaggaagtttgtgttttgatgaaagaggtttgagttttgtattttaatttaagtagtaatgtgggttgggttgagtagggtagggtggttttgtttattatttattggggatatgttttaaaaggggtgggtttgagggtaagttgtatggtgattggtgtgggttggtgagtgatagtgtagtttaggaaattttttttgttgttttttttaggttagttttttatttgggtgattaaatataatgaaaatgggtgtttgatatttttttagaagtggtataaaaagatagtaaaattaggttggtaaaatgttgaataaataaatgaaagtgtttggtttgaatgtgaatgatttgaagggagaaggggtttgaggagattttttttggggaatgatggatattttagaattgaagttaaggttataggtgggaggtgggtgttattgtgtataggggtgagggagttgttttagtaaaatttgttatgtgggtttttggggattgttaggagaggatttgtgttatttgttgattttattttattttagtttatgttaggtggtgagagtgtaggtgtgagaagataggttggttaaagaaattaggaggttgtggggagtttgagttataggtgggggttattgttaaggttagggaggttttttttattgttagttttttgtggtgattttttagtttaggtggattggttaattattagttatataggtttgaggtatgggttatgttgtgtgtggggaattgaattataggtggttaatgttagtgtatagttttaagttgattaattgttagtgtgtggggtatttattatggagtttaaggttttgttatatttagttattgttttgggtttttggtttttggtggtagtgtttgtgagggttttttaaattagtgagtttttttgaaagagttttgtttaaatatgaaagagatttagttttaagatagtggatattgatgttgtatatggatgtaatttttttgttttttattaagttttagaggttttgttgttttgtttatttttgaatttttatttttatttattgtaagtttaatttaaagtgtattgtatgtttttttgtagttaaagttattaatatttgtagttagggttgtggagaatgtgaattaaaataataaataagaagagaaatatttttgtgaatttgggagtttgtattgtttggggttgtgaattttgttattgttatttgataatttagaaggttttttgtgtatataggatttaggttgtttttttaatagtttttagggatgtgtgtggttgtggtttatatttagagaagttgattggttttagattttaggttagtaagttgtaagaatttaggaaaaaattatgattagttatgtttttgtaaaggaatagatttttagatttttatttttatggttaggatgtattttaaatttaaaattatttaatagaatggaggatgtgaaaggtaaagatgaattaaaatattattttttagaattggaattttgggggaaattttataattagatatatttgaatttgtttttttttgttggttggttttaaatgtttaaaatttttttgaagtttgatttgatagtaattttagtttggtttgatttttaatatttgttgggtgatattgtgtggtattgtttggtatttttatataaggagagtttttggaaatttaaagattttagaagtagtagtttttttttaaggttggtagataaattagttgagattttgttgtattgtaggggagtttatgattttgttttaggtttgtgggagggaatgaatatgtttggtaatttgattaggaaggaatttttttttttttttatagataggtagtgagtattgatttttgtgttaaatttgttttatttttgtgtatttagggaaaatttgtagtttgtagggttgttaggtgggtataaggatgtttgtatatgaataggtaagattttatgttttgtggggggtttggggattttgtgagagttttagtagttttgtagtattagtttagattggtttagaaattgatatggtttagagttttggttatatggaggtaatatataatttttttttgtttttattaatttttttagttgttatatatttttttagtttttatataggtttaatgttatttttttttttttatttgttgaatttggttgtgattatgtggttttagttgttgtggattttttgggtgtgttaggggtagtaatttagtgggtagggggtttgtttgtagttttggtggttttttgtaggttttatttatgttggtggttgtaggtattgggtgtttttggtatttttaagagtgtaggaagagttaattttaggtgttttgggttattaagtatttgtggtaagttgaagattttgttttgggagtaagagaagttgaagttgtagatagggttagtgggattttagtagaagagggtgatgttgaagtttttttggggtgtggattgagtgttagggtgaggtagttagtgatttgttgagattgattgagagatgatggatttgaggtagagaaagaggatgaaggaaggaaaagagagaatattaaggtttggttagttttgatgaatgtaaggatgtaggatttagaataagaataagggttagttggagtttgttgtttggttatattgtttattttggatttagaagattttaaagagattggaagaattttgattaaaaggagaaatttaagattaaaattaaaatattagtaaggtttgtagttggtttaggttagggagaagttaaaaagtttttttttagttgtgttgaggttttttttgaggggtgatttgttttttggataaatatttatttagtgggagattggaagttgggttgagagtgtgaaggagggggttatattgggtgggaggaattagtatatttggtgttggttggatttttgtgtatatttgtttaaggggagtaggggttggggattttgggggtgatttggtttaggtgtgtggttggggaagttttagattttagtattggattgattggattttgttttgtttttgtggattttagttagatgttgtgaagtttttataaatttgttagttgttttagtgttgtgggtagttatttgtggtgttttttttttggtgttagagtggtttgtggagagatgtggagaagtaatgggaatttagtttggtagattgtatttgagggttgttgaagttagatttaagtattataggttgtgtggaatgtgaggatttttttttgtatttttaatttggattgatttttggaagtttgtttttttgggtttataggttagtgatgattgtggatgggaggatagggtgagagttgggggtgtgtatgtatgggagagaggttgttttattttgagttgtagttatgataagtagagttagtagaaaatattaaggagttgatttttttaatttgttttttgttggggataggattttttttttttaagtgaggtttaggtgatggtgtttgttttttgtttatttggaggagttgtagggattgtaagatagttagagtttgaggtttgggattgggatttttatagtgtattgatttttagttgtttgggggtaaatgtagtaaaggtaagattttttagggttagttggggtattgtgtgtggtgtagagagaaaaataagtttagtttttttagaatttggttttttgttatgtttttgttttgtagggtaagtggttagttgagtttttttgaaattgtagtggtaagtgatagttagaagtttgttttgtgtttagggtgagggagggtttgttttggattgttggtttttgtaggatttgtgttgtgggaggggatggtggttaaaaggagtagttgtggggattggggatggagatagtttttaggggttttttggtgggagaggaggataggaggtgtttgtatattgatttgtggtttggatttggagggattgtggatgtgttagtttaaggagaagttgtaagtgtatggagaggagtagagtttggttggaagatgtttggagaatagtttggtagtttttttatttttttattaaggagttttatggtttaagagtttttttgtggttttattaggtagttagaatggtagtgggttgggttgggtttgagtttggaaatgtgttttggtgttttgtggtttgatagtgatatgattggagttttgtgggaggtgggattagttttatgggttgtgagtgtttgttgtttgttttttttttgtgagagtaggggaggggtttgttgttgtttgaaatttgtttttaattttttgtttgtttgtttttgattatttggggttggtttttttgtttgtttattttttttattataataaaaataattgatatttttttttagtttttttatattagtgttatttagtaattgttttttatttttttttattttatgtgttgaaggtgagtgggattgttggtatttgtgtatttggaagttttttgagtatataagtaaattttttttaaagattttaaagtaaaaataaataatggtttgagaaattgttgtgattttaatattattttttgaaagtaaattatatttattttttagtttttaatagtggaattgtttttagaaggatagtgtggagttttatgtgatatggttatgtttgtttattaaatttgtaaatgaaagagaatatgttttaatgtatggggtaaaattttgggttgtgggattgtaagagtgaataaggattggattttaatagaggaaggggggagtggtttaggggtagggaggggtagggaggggtaggaaggtttttgaggggaggttgggttgatttagttagagggagggggattttgttttgttagggttgtagtattagtagaagttgtgtagttttgtgaggaggatgtagtttgtggttattatatagttattagttgtagtgtttaggagaggtgtagttgtgtgtgggaaaagtaagattgttggttttttaagtatagttgtttgagattttgtttttaggtgttggtttgagggttttggggttgtttttttttaaagattttattggtttaaatgttgtttggaaaagataaatgagaattaggttgtgtttttaaattttggttttgggatttatatgaagttttttgggggtttttattgtggtttgagttatgttgaatgtagttttattgtaaggtttaggttgtttgtaggttgttaggtttagtttgttgtattttgattagagttggatgtttgttttttaggttttaagttttggttgggtttgaattgttgatggagggattaatttattttagatttaatttttggtttttgaggagtttgaattaatttgtaggttggagttattttgattgatttgaatgtttttttatttttagtgatttagggtttatttattgtgtgttttttttaggtggtatgatgtttttgtgagttgtttttagttttgtggtgtttggtgaatttttgtatttgagtagtggatggggtgatagggggttggtgtgttgtaaagttgaggagttgtgtttttagtttgttgttttttttgagtttattttgttatttattagtttttgtgttgattttgagagtggagattggtgttgtatagttttagttaattttttgaaaataggaagtggaggttgggagtagtgggttagtgttggagttgtagaaaattttttgtagtttttgagttttttagttgttttttttggttattgtattttgttatagtgttatttataggagttagattagattgtgtatttattgtagtttttgataaggttgggaattgtttttgaaaatttatagaattttaaagtttgatatttttggtttttttttttagatttttttgtatttttaattttttattgattttaaggttttgtattattttttattatgttttaagggaaatttgattatgtttttttatgatttattgaaaatttattttttatgttttattgggtggatttttttgtggtttttaggggttatttaaggatattggttgtgagttgtttttgtgttagggtgggagagttggagatagtaaagaagttttgtagggaagggtgtggggagtgatggatttatttttttttagtttattttattatttgttgagggtttatgttaaatataataattatattaaggaggtattattttagtttttattttataagagatattaaataagaatatagaagatatttggattaagtgaaattatattgttaattaatagggggaaatttgaattttattatgtttttattgttgttttttttatttttttaatttgtaggagtagtttatgttggagtttttaaagaagtttttatattttaggtgtttatattgaaagtggatatttttttatttatttttatattttagaagatagaatgttgtttaaggttggatttagaatttgtagtaaagaggatttgtaattttgttttttttattgttggttaagagtttatgttgtggaggttgtagttgattaggtgagggtgggagattgtttgtttgtttttttttggttttggttatttagggtgttgaggtgaggtttgtagttatttgggtggtgtataatatgttttaggagttttgtggttgagtggtgtatagaggagtaaggagaggattggaagaattgtgtttttggttgtaatttgtttttaagagtgttaagatatgtttgagatttttagtgtgtttttagagtattaatttaagtattgaaaaaatttatttttgtttttttggggatttattttggggtatgtttgtgtgtgtttttttttaagattattatagtgggaataaattaggaggtgttgagttgtaataaaattagaatttataattaatatagttagttgggtttaagtggtttggaagtgtatgtagtggagttagttggtttttttttgtggagtttgggttatagttgtgttttttttttttggaatgtattttggagttaggattaattttttttattttttgtaaatagtgaataaataaattattttatttataaaaaatgataatgataaagagattttagtgtattttgtgagaggtggtagttaggagaagagaaagtttaaaggttgttaggtgtaggggttatttttattgttttgggaaaatgtattttagttgtggaatttgttttgtggggattgggggtgtgtttttgaggtgggtttgagggttagaattgtgaaattttaagttagtgtttttaggttttggataaaaattgtgatttatatgaggattttattgtttgtattttggtggggattatgaaagttttataggttagtaggaattttgtggttagtgggggtatttttgtaattttttgtgtagggattttatgttttaggtttttttattggttggggttggtttttttgggaattgggtaggttttaataggtttttttatttgtaggttgtttgttttaagaggtggatttgtggggtttagggtgaattttttttttttttttttgttagttagtgttttttttgtttaaaaattttatttttattaggattaatgaaagagttgattttttattttttttatagtggttgtggttttttagataagttgtgtgtttgagttattgggagaatagagtataattatttttttatggatatgattggaaggtagttttaggaaaattgttaaaggatttaataatgtttttaatggatatatagaggttaaggaagagaaatgtaaaaatgaaataaatataattttaaaagtgtttaattttttaataagttaggaggggtaaaatatagtattatttttgtagagtaaattaattttgttagtaggtataaattgttgtgtttttttttaatgagagagggggggaaaaggttgtttgtatatgatttatattttttattaataaaatgtttttaaattaatatgaattagtttattttttttggtgggggtgggaattaagtaagtgttgttggttttttttaatagatgtattgttttttgtatagaggtaaaaaataatttgtaaagtgttgtttatttagtgaagttatttatatatttttaaattttaaagatgtttaagtttataatgttattgtgtaatttattttggtagtgtatttaataaaaattatattattggtaggatatttaataaaaattagattaattagtaaggaagggtatagtagataaaaaggataaagaaattttttgagtagaaaatttagaaaaataaagaagggtttttagataatattaattttttgtgtattgttttaatttttatagttttgtttattgtagtttttatgtattaaagtgttatagtttgggttttgtttttatgttatatttagattgtaaatttaatggttgtaggggggagaggaaggattgtaaaattagagattagtattagaaatgttggattagtgttttatgtatgatgtagttatattattgaggttattatttttgttagatttttagggtggatatagaggattggggaagaaggttagttttattttttgtaggattaaaatgttagtttaatatattggttgattagtgagttattttttagaaggatagaaaattaaggttatggttataggggatttttgaaaagttttatattatttttttgtaggattagaggtgtgaatttgatgttttggtaagttgataatatagatttttttagtagtttttattgtttgagtgatttatatttaatttttttgggattgagttttgttttgttatatgtttttatttttggagatattttttttattaggaaaagaaataatgattttattattttatgtaaaaaatttttataatgttagtttaaggttaaaaattaaatttttgaaagttagaatatagaaaagttaaaatttttttagtttgtttaaattattttgttttttaggttgtataatgtatggtatatttataagtttttttagtaaagttaataattagttttagtaattaggtattgttgttgttgtgttttaaaggggaaatgttggagtattatttgattgggtagattttttatttgtagtttgaatgttttatgttagtagattttagtatttttttgttagatgaaagtattatattgtatgtattggtaaatggatttaaaatttaaagaaagtaaattaatttataggtaattaaaagtaatttaaaataagagagagatattgtaaatattttgaagattttttaggtatttaaaattttttaaatttagttgtagtattttagattagtgttatatatttttttaattttgatataaaatgaagttttttaatggtaattgatgtaagtaggtatattttttttaatttttttttaatttttattttagaatttaatatttatttatttagtttttttaagaggaaaaaatatagttagtagaaagatgtgttatttaaattgtattttgaaaatttagatatagtttatataaggattataatttttagaaaaagttttttttatttttttttttaattttaaagtagttaaaagtatgagtttttttttataattagatttatttataatattttggttgtgaaataaaattatttaagattttttgttttttttatattaaagtgtatatatatatatatatatatatatatatatatatagaaaatagagggttaatttggtagagttgtgtgtaagttgagttatggtttttggttataatatgtatatgatttgtgtgttttattatgtaattgttaaggtatatgagggttttgggggataaaggtattaggtatataggagatattattatttttattagagtaattagttttatggagaaatatatatttttagggtaaaatatatattgagttttgtaaaaggaatgaataatatatatttggatattattatataaaagttgtatttttttttttttataggaatattttttgtgttaataaaaatgatgaaggtaaagttaggtagtttggatgtgttattagaatttaaggtataatttgggattttataattttattatttagttgtttaaaaaaaattttaaatatatattttaaagtttttttgaagatatgttttttattatatagttaagttttaattaattagataatttaggaaagtatttgaaggaggatatggtgttttgtgaatattttttaatgtttttgaataaaatagaatataagaaaaggaagtgtgtgtatgatgtattgttttttatgattttttgatatgaaaaatattttagaaattaatttaggttatttttatgttttttttagaatatagtataagaggggtagtttagaaaggtgaatttaaatggatgtttttttgataattataattttttggtaaatataatatttaggtagagtagaatggggattattatatattattgtgataatagtgaaaattaagatagagagtttgaatagttggtttttgggtgaagaatagtattttgagaaggaagatgaaaaggggagagggaattgtttttgttaaagattaaagagaagatatttttttttttttattttattttatttttattattttaggtatttagggaaatttaaatgaatgttgggattaatagtagagggatataaatattgtaaattaaatttattgttatttttgttataataaatattgttaataagtttgtatatatatgtgtgttataatatatttaattaatttatttataagaaaaatttgttaatttatttttgaagataatttatagtatgagatttttagaaatatgttaagtttaaaggattgaatttagattttttatttgttttttaagtttgttaaagatatgtgtttagtttatgggttgtattgtaggtttataggtttttttttttttgttttttttggaagttagtattgatttggggaaatataaagtttttattttgatgtatattattatttgtgtttgagaatttggtattaagaaatggtaatgaaaattattgtaaattgtattagttaattagagaaagttatggatattaggagagtttgttttttatagtattttatttaatatttttttttttttttagttttatttttatttttttttttgagattttttttttttttttttttttttttttttttttttttttttttttttttttttttttttttttttttttttttttttttttttattttttttatatatatatattttgtatttatatattttttagaagaaagtagtattttatataagattttggtttttaaaatgttgtttttttattaaaattttatgaaatatttgaaagtatattaggaaattaagtataatattattaagaagagttttagtgaggttttaaagagttagttttttttatttagatttttaaatttattataaatgtatatatgtttggattaattttggagtttatattttaaataatttgtgaaaaagtatatttagatttttatatgttttggagaaattattatgtagttaatataaagttaatttttgttatttgtatttgtttataaatttttaaaagtaggtagattggttttagttatatagtattaaggaaatatgagttttagttaatttaaagtggagtttggagtgatgagaagttatttaaagttattagtgttttgtggttgttttttgatttatggtttaagtttatttatatagttggattagaaatgatgattttgataaattttagtttattttttggagtttttttggaatattagtttgggttattttttgtagtatagttgtatgtgttaattttagggtagttgtttttttttaagtttatgattgagggtggtaagaggtagtgattagttatttaattttttaatagttgtaaatattaattgaatattttgaataattttttaggttatatgataatatgtggttatttgttttttagatttttattgtatagtttggggagtaaatattttttaataattgttaaatatattttataaattttttaaagaggaaaaagtttttatttaaaattaaatataggttatgtgttaaaaatgggtagttggaattaaaatatagttgttattattttttttataataatatttatatattattaatttttttgtaataatggaatattaaagaataaaatgtaaattttattgttttatttgtagggatgaaggttagagtgttaaattgtagattttggatttttaataatgggttgttgtatttaatttttttaattttttttttttatttataagaaggaataaaataaaatgttttgtggaagtttatattgaaatgaggttaggtaaattaatgattgtttggtattttatgataagttttataattttggagttgttataatttttaaatgattattaataaagttttattgtaaaagggttgttatgtgtttgaatgtttttgtatatagtaaagttatgttgttttattgttgtagtttattagtttttttttattttagttataaagttttttttttttttattggaggttgaaaagtttttgggtttgtttttttttattaagttggtaatgtgggaataatatagaaattaaattatatgattaaatgattgtatataattaaatttttaagaatatgtaataagattgttttttaataattataaatttggattttaaatgggttttatttaataaaataaatgatagtgggtggtgggtgggaaaggaggaagttagatgagagttttttttagaaatttgtgtttgaatgttagataagatttattagtttatttgatatatttagagggttgttattaaataattaggtgtttagggattgataatggttttaagataaaataatgaattgttaaagattttttgagttgatttgaggattttaaagatttaagaggttttgtattgtgttttaatttgaatttttttatggagggaagggttgggttatagtttatgtttgtttgattgttgtttaatatattttttaaatgttttttaaagttaaattaagaattttaagtgtttattttatggtattagttgttaggtttaggtttgggtttgtttattttttgtttattgttgaatgttatgtggaaatgaagttgagaataatgttttgtgatttagatgaagagaatagtaagaaaggtagtatgaaatgaagtttttattgatgtgttttttagataggtattttgtaggtgagggttgtgatttagggagagagtgtgggagtgttagtagagtggtgggagtggaaggagaggttggatgaaagttggaaaattattttattttgggatttgagtgtgagagtttgttttggagttggtaagtttttagggttagaaggttttagttttaaagttttttgttttggtttaggtaggttttttatttttaattttttttgatttgtttggttgtttttggggaagggattggtaaatattgtttttttttggattttttgaaatttttattagtgtgttgaatttgtttttttttatgtttggtgttttgtattttgtgtttgtgtttattgtgtgttattttttttttggttgagattattagagttttagatttgggatttgtggagggaataggatttgagtttttgttggattttgtaatttggttgtggagagtgtgtagttataagtgttgttttttatttgagggttttgtgagagttggtttagttttgtgggtttttgttagtttttgttagtttttgttagttttggttggttttatgttaagtttgtagtaggtgggaaattttgtaggtttttttggatttatgaattgtttatttttatttttaaagagtttagatttgaaggtgtttttatggtgtgtggttgtaattttggagtggaatgggtggggggtttttatggtgaaggagatgttgtgggtgaattggtttttagtttgttttttatgttttataggttattagttgagtttttattttgggtgtttttatgaggtattaagagtagttatggtttagggaagggtttgggtttttattgttggagtgggttttagttgagggtgtgtaggtgttggggtttttagtaatttttgtatgtgtggaaagttgtaaatggggttttgaggttggtgttaggtataaggattattttgtgttatgggttatggtttagagtgtttatgaagtttggttgttaggtttaggttgtggttgggtgggatttatttgttttttatggtgttggtgtggtgggagttgggttggttaaggtgggaggttggtattgttatgggttgtggtgtttttttttgaagatattttgttggaagtgtggtttttgtttggtaggtgttgagattttttggttgtagtgtgaaggttttggtttgtgtaattttttataataatgttgtgaaatgtttttagaaatgtttgtgtggtatggtgtttgagttaatggttggtatttgttttttttaagtgtggaaaagaggattttagttttttgggatgagttatgtatttatatatgtatgttggtttttgtgtttttgttaggggaagtgtagaaaggtggggattttttgggatgtaattgtttagtattatttattaagagaagttattttttttttgggattatagaattttttttttatgtttttaagtttttagtaagaagtgggagaggatgtgtgtggttttttagaagtaggttttaagttgttttgggggtaagttttttggaaggaattttgttttgttgatttaatttgagtagggttattttggttgtggttatttttattttggttttagggatgaatttagttgttt

SEQ ID NO: 77 - DNA, 21430 bp, Artificial Sequence
  chemically treated genomic DNA (Homo sapiens)
tggttgggtttatttatttttttagatggggaaattgaggaggtaagaatttgtttggagttttattgtttgagttttagggttgtgtttatggtggggtatttagggggaaggggagggtttttggtatgtgttgagtttttatggatgtttggtttttggtttttgaatttttttgggtgttttggattttttgagttattttgtagataatgtaaggtagtggttaatagatgagttttgtagtagttgtgtaggtggtgagtatatgtgagaagtttgtgaaaggtgattagagaaagggagaggaaggtaagttaggtggttgtgaatatttggttaggtagttttgttagttgttttgttgtgtgatggtattttgagtttgggtttttttattggggttatattttattttattttttttgttttttttttaattttttaatgtggggtttgggaatgaaggtgggtgggggtagttgttggtttttttaagtgtaatttgtgtttggaagtatgtttggagtttggttagtttttggaagtaagaagagaagtaaaatttgtttattttatttttttggattttgggtttgggagatgggataattagtgttagtttaggatgttagttaggattaatttgagttttagaattagataaattaaggtttttttttttatgttattattgtttaattgtgtggttttgggtaatttatttagtttttttatgtttttttttttttatttgtaaaatggggataatgatattaattttataggtttgatttggagatttagtgtataatatttttaaagtatttagtttagagttttgtatataggaattattttataaatggttttttttgttattattattatggatatttttttggttagagtttattaatttaatatgaattatattaagtttttaatgttgtttggtttgtagatatgggtattggaaatatagatagttttttaaggagtagagattataaaatattatgtttttattaagagataataagggaagatgtaaaagatattggaagtttaaagaaggaaaattttttttgagtttttatgaagtttatataattagggtaggattttaaaataataataataataataataataataataataatttaagtgataagggtatagattaagttttttaagtttagagttttagattttttgtatttaaaattatggatgtttattaaaaagtatgttagtttttgaggttagtatttttgggtgtgggtttgtggtgttgtattttaagaggttgtagatgatttttatatatattaaaattgagaattgttggtatataggaaaatgtatttgtttttaggtttttattttttttgtatttttataaggttagtttttttggaggatatggtgttttgtgttttgattttattttatatgtggtaaatttatgtttttattagattttgagtttttgaagtagtgttttttgtatttttaaggttttttataagattttgttgttagtaggtatttggaaatgtttattgaatggggaaaattttttttttaatgttatttgtataaatgtttatatagtttttatatggatttttatatattttgtttggtttataaatggtatgagtgtgtgtgtgtgtgtgtgtgtgtgtgtgtgtgtgtgtgattgtaatttaatgttatggtggtgggggggggggtgggtaagtgttttttagtttattatagttttaatttttttttttatttatttagataaagttgtttaattttattttattagttttgtattttatagaatttaagtttataaattttggaaagtatagaggttgttataaattgttgtttaaggttgtttttttaattgttttttttatggttttttttttttttttttttttagtttttagtttgttatttttaaggtttttttaaaaagattggtttttaaggatgggtgttgttttattgttggttgtttagaattgttagtagatttttttagaggggaagatgggaaaaattttaaaatatatgggattagatataggtgtgttttttgatgtgtgattttaatgtttggggatgttggagtaggggttggtaaggtgaaggttaatattggaggtatgtgaggattagttagttttgttttgtttttgatttatgtttgatttttatgttggttagtattttttagatttttgagaggatagagtagaaaaagagaatggatatgaatttttttttttttagtttttaggggtttagttttatagataattagggtattatggaatgattatgggttttagggtattatgggattaggtaaaatatagattagtgtatttttgtgttttattttttttttttttttgggtttttagtattgggaagaaaataaagattggttttaaattttagtgagtgataaaatattgtatttagttttggggagttgagtgtttttggagataaatttttgatatgtttaaagtatgttttatttaaattaattagaatgatagttttgttaaagttggaagttttgttaaagtttagtaattattttatatagtttattttttgtaggtaaattgaggtttagttagggttatttatattttgtgttagaatgtagttttaaatttagtttttttgtagtttatagttttgatgtgtattttgtatttttagaattttgttatttttatgttttgtgttttgtttatgaatttattttttttttattgtttggtaagtttagagttaattttttgaagtgaatattagattggtgattttttgagtgttaggatggattttgatttatatttgtgttttagtttttggtatggggtttggtataatgtagatgttgggtgaatggagagtaaggatttatagtatgtatgtgtagataaattgggttttaggaggatgatttggtttatttttatttttatatgttttttttttaagttgaggaagaagagaggaatatgtatttaatgatattaatgtgttaggtattgtgttatgtgtttattttagtgtattttttataataattaatgggaaataaatgattatttttattttatagatggggatattgtagtatagagaagttgagaatattttgtggttttagttagtaagaggtagaggtgtattttgaatttgaggttagggtttgagtgttatggtattaggttgtgagggagtttattgagtattaattttgtggtttaatgtttttttttttattttaattttgaatgtttttattagaatttaaggaggtagatagtagtgtaattttatttaagagttgttgaaattgaggtttagagggttttagtgaaagggttgtgtttggttttaggtatttgggttgagttttttttttattattgtagggtgggaattagtggagggggttggtttggatggggagaaaagtaattggagggtgttgaggggaagagggagtttggatttgttagggtgtttttttggattaagggatgtttttttaaattatattattttattttgtttagattttgggaaatttggtatgtatatattttgtataataataggtagggtgaggtttttaagttttgaagattgtttttttagtggaggtagtggttttgatgagggggtatagttgtatgtgtggggtttttttttgaattggagtgtagtgtagttgaggtttaggattttttatttattatttatgatgtttattagagtggggtaagggagaggaaagaagagggaagtagagagaaaaagaggttaggggaggtggaggtgggtagtgttaattttgagagtttttaagttttgaaattttgagaaggaagattaagaggttaaggtgtttgggaagtagtaggttgttagtaaatatttgtaagatggatggataattgggtgagtgagtgaatgggttaattattagtttttttgatttttgttttttttatttgtaaaatgggataatattatttattttatatggtgggtatgagaattttatgggtaaattttaaattgtttagtatatattaggaatttttaaatggtagttgttgttatgaggaatgggtttgtaagttttggttgtttagtagaaatgtattgaaggatttttaggtttggagggttattttgaatagttgttattttaaaaaaaatattttataagtttttttagatgggagggttggaggaagagtgggttaagttatattttttaaatgaaagaaagaaaggtaagtgtggggaggaagttattttggattgagaaggtagttattgtttttatttttattttggagtgtggttgagggaggtggggtaggggttatttgggttttgttttggtagttttttattttttttagggtttgtttgggtgtttggaggtgtttttttgttgtgttgtgggattggattttggtggatagtttgggtgtgaggttaggagtgttttggaaatgggtagtttggtggtagttgggttgatggagtgtgtgtgtgtgtgtgtgtgtgtgtgtgtgtgtgtgtgtgtggtggagaggggaagttggagtagggttaattttttgttttagtttagtttagggttatttttttatttaggtagtttgagttgggataggatggagaggttgggatttttggggtggtatgggggaagggaagtttatgaagaagaaagaattggaaaggtttggtgggttggagttagtggggtggggtggattgggagaggttaggttaggtttgggtataaaggttgtggagggggtggttgttgtgggtgtagaaaggtgtgttgttagttgttgtttttttttattttttgggttgtttttgtgagtttttggtgtgtgagtatgtttgtgtgtgtttgggttttttttggtaggttgtttgtaagatgagtgaagaagtaggtgggggagaggggaggtagtgagtgagagggtgaggggagtgtgggtgttgagtagtgtttatttggagagtggtaagtaagttagataagtttgattttatgttatttgttgttattttgttaggagtgtgaagatgatggttatgaattttaagtagttttttggtatgtatttggtgttgtaagaatttaaattttttagtttgtattttggttttgaggttatgtgttgagtttgttttttagttttgtaggtatgtagtggagtataattattgttttaaggtatattttttgataggtattagttttatgttttttttatgttgtttagaataattgttgttgtttgaatttttttttttgttttttttgtgtttttttttggtgtgtttttttttttatttatgtttttgatttatatgtttgttttagtagagttgttgtttttgtattaatttttatgatttgggttttgaggagaggtattttggttgtttgaaaatgtgttttaattttgtgttgatagtattttttattgattgtgttgtgtgtttttttgtttgtagttgtagggtaatatatttggaagttttgatgagagtttgttggtatgtgttgaagttttggtggtggtggatattgttttttatggtaagaattatttgtttaagtttgatgttatttattatattatgagtagtgtgttttgtatgtttattttgtttattgtgtttattttttatttagttgtgtttattttatatttttattatgttgtgtattagggttttgaaggtgatttgttggagtatattttgtttatgttgagtgtgagtggtttgggtgttttggaatatttggtgatgtttgtatagatttatttatattatttgggtgttatgggttatttgtattaggttatgggtatgagttatttgtatattgtggttttttatagtgttatgtttgtatgttttagtgatgtggagttagatttgtgtgagttggaagtttttgttgagtgttttaagtagtggtgtattaagttgggggtgatttaggtggatgtgggtgtggttttggttaattttaagatttttggtgtgggtttgttgagttaaagtattatttgtaggtttgagttttttatttttttgtataataatatgattgtttttaagttggtgttttaggtttggttggaggaggttgaggttgtttattgagagaagaatagtaagttagagttttttaatggtagtgaatggaagtgtaaatgtatgtttattgtggtgttggagaagtgtttatttgaggtttattttgttatttagttatgttttttatttgagaagattgtggttattgttgagaaattggattttaaaaagaatgtggtgagagtttggttttgtaattagagatagaaatagaaatgaatgaagtatttggttgtttattgattgtggtagggtgtagtgttgggagttgggagagtttagtgtttattttttttgggtttgggggatggttattgggaattttaaggtgttttttaggtaggttaggtttttttttttgaagttatagattttttttttttgttttgtttggttgtttttggtttttttttttttttttttttatttttattaaaaaaattttggtgttgggaaaatattgtagaagggtgggtttgagtgtatttgtgttgtttgtggtgttgaaatttgtttttgtgtaggggttgtatgattttagagtaggagttttaaagtagaggatagttaattggtttaattgtttgaagttagggtgaaaatgttattttgttaagtgtgattaggtaaagggtgaagggataaaaaggaagtgattaataataatataaagtttaggatatttaagggggatataaatatgtattggagatttattagagtatataaaatatatgtatgtttttaaaggatagttttatatttttttttttgtttaaattttatttattttattttttggtttggtgtaaatttttataaggtagtatgaagattaggtttagggaaagtatgtagggagttgtgggttttaagttgttatttttttgtggtaagtagggttttaaaataggtgggtttagtttggtgattgaaaattttgggattgtttggttgtttgtaattagttgttagtattagttttggttattttttattatttattggtgtttgaggggtaattattgtttgttggagagtgggagtttgtagtatttataattgttgaggattttttgattttagtttgttgtttttgttagattgttagtttagtgtgtagttggttgttggaaaatgattgtaatttttttgtattatatgtaagtttttttaatatgtttaatttttttgtatttttgttattattgttgttgttaatattgtttattattattatttatttaattttgtttttttttattttttttatgtgggtgttttttggtggaagtttatttatagttttgtgagggaagaggagtgggattatgggtttgaattttttttattttgtttttttagtttaaattttattttatttttttgttgttttatgtagtttgtgtgttgttgtgtgatttttggttttattttttgaatagatataaataaaatattaagtttttttttttttttattttttgaattaatttttaaaataaatgttttattttttaatttgaattaaagtggttttatttttttttagaggttaaggggtattagttttgaaaaggatttaaaaaggagaattttaaagggttgggttgttagtttttgttgtttagtttttagttattttttttttttattttttttttatggtagatttatttggagttttttgtgggagattttgtggtttgtgtttgaatttgaggttttaaggtatttttttttatgtttttttgtttgttattatgagattttgtttaatttgatttagttagtaaattttgaagttggattaatagaaatttgagtttttaatgtttttgtttattggtagaattattttgaggttaattttttaatttttttaagttttttttaataagattgtttgtttgtagaatgaagggattaatgtttattttataaggttattgttaggattaggtgagattgtttatttaagatgttaattagtgtttgggttttgtaggtaataaattattttaaaagatttaaagggtttgaaaggaggtgaaataatagaggtaaagagggagaaaagtgtttgttgggatattttagtgggatttatttagagttttaaatttatttgaaatttttatttaggttgttatttattttggggtttattttggtttttttgtgggggtattgttataattgttgtaaagtgtttagtatagtgttttgtatatagtaggtgttttatagatgttagttttttgttttttttatgttttttttttttatttgtgagttgtagaaatgtttttttgatttaaaatttaatgttttaagtttaggagttatttgtatatttttttgttttgtttttaaagagttgtgggttattaaattatggggttgaaatttggagtagagtgggtttgttttttgtgtagtgtgatattttttattgtataagttaatttgtggattttttttagttttttgggttttagttttttatttttgttttgtataatagttttagtgatttttttatttttttttttattgggtgttttttaataataaatgtttttatgttattatattatattgtgggttttgaaaatttaaaatatggttgatgtaatattaattgtttatagtggtataaaatatagggtaggagtttagttgggttgtagaggagataattgtgagtgttttgtgttgaagtgaagtgttttagaaggatgtgtttttgtgggttgtaaggttttttgtaggtaagaagagtttttgtatgtttgggttttggagagaattggaaatttgtttttattttttttttgaaaagttttttgttgttatttatttagttttttttttttttttaattgataattgtaaaagtttgggagatttttatggagaggatgagaggagttgttttttgagtgtaaggtttgttttaagatggtttagtagtattaggtttagtttttgagttatgtttttgagtttagttttttttaggtgtttgagatggtgatgtgtaggagtatttttattagtttttatgtgtaggttggagttgtagtttggttagtgaagtgttttattttttttttttttttgagtgtgttggaatggtgttgttgttttattttttggtttgttttaggaagtaattggagatgtggtttttttaggattgtgtagttgtttttgttatttgtttggtggaggtatagattttttgggggaggggaggtggtattagtaggtttggggtttatataaggttagtatgtatttgaattgtgtgattttggataagttatattgtttttttaagtttttgttgttagttgtaaaatttttttaaatttattttgaagagtaattgagggtgttttttaagattatttggagtaggtttttatttttttaattttgttagtttgtaatatgtatggtttaagatttagttgagagtttttttaatttgtattaagagaaagtgaagttagtatttgggggtgtttgtatggaaatttgtattgggtttttggagggtgggattttgagaattatttggttggaataggggttttatttagaatgagttaggtatatatattttagtatgattaaagttttggtaggtagaatttggtggtaggagttttgggtttttgaatggtgttatttttggttagtgattttttttttgtgtgtttaagtagttttagttttgtttattattttatgtttagtattttgtttaaggtttggtttagagtggtagatattagatgtttgttgaatgaatgaattaggtttttgttttgtaaaatgaaagtattttttttagttgaattttttttggatttaagggattgtagggaggaatagagttattagggataggtaagtttttttgggaatggggattggggtaaggtggtggtttgtattataggtttttatttaaggtagttagtgttttttttgtttaaatagaagagattgtgttttattttttggtggttatgggtatataggggatgttttgtgatatggtttttggaatttagaggaagagttagggaggggggattagggagtgattgttgttttgtttagtgtgtttgatgtttgagttttagtttttttattgtttttttgagatggaaatagttttggttttggaatggatatatttggggtggaataattgttttattttttatttaagtgattttattgttttgatttttagtgtttttatttgtaaaattggaaaaattggaaaaaagatttttttaggattgttttgatgattaaatgagattatgtaaggttagggtttgatatatagtaggtattaatagatattttgttgttttaaaatattttttgtatttagaaaagtgaaggtattgttgtggggtaagtttagggtttggagttaagtggaattaatattttttttttgtgagttatagtttggttagggtagtagtgtttattagtttttggagtggttgttatgggtaagatggaagtttaaaagaaattgttttgtatattgtgtgttttagttatgtaaggaatgaagtattttttttttgggagtgtttggtgtgaatatatagtttttattgagaagtttggttttggttagtggttttaggagtttggaattttttttttggtggaattttgggtattatttagtttttttgaaggttttagattttgtgttgtttttttttttgaggaggggtggggtgttagagggtaaaggagaagtaagggttttggatttttttttttttttagtgaatattttttttttgttttgtttttattttttggttttggtgttagaatgtttgagttgaaggggtagaatgtttaaaagttgtgtttgtttatttatttatttatttatttatttttattttttaaattgaagaaggtagtgaggtttagagagtaggatggatttagttggttttttttatttaaaatagtttttttttaattatgttattatattgtttgttttattttttttttagtttttaagattgtttgatagtatttatttagtttatttttgtttttttgaatttaatgtagggttttgtatagaataagtgttttataaatgtttgttggataaatgattagtgatgatatttaaaatgtatggtgggatttttttatgtgaggtattgttttaagtgttttagtgtatttgtttgttaatttttaaataatattatgagtaggtataatttttaattttattttatagatgagaatatggaggtatggagagtttatgtaatttgtttaggataagttatgaatatagttatttagtggagagatttggtaaaaatttggtgtttttgttttttttgtttttaagtgagattatttttggttggggtggggaagtggattgtttgggagtgaaggaggagtaggtgagtttgatttggtattagattaggtagtgtgagtagaggaggtggtgggagttgagaatgtttgttgtttttgttgggttttggagtttttatgtttttgtgttttgtgtgttatttgtgttttttgttttgtttgtgtgtgtttgtttgtgtgttttttatttagttttttttagtttttttttagttttgtgggtgtgaaattttggtttttatgtgttggagtgagggggtttgtgtttttgggtgtgtgtagagttgtttttttttttttttttttttttgtagagtggtgggagtttttgtggtaattttgttttggtgggtagatggagttagtgaggattttggtggataaattagttttttttttgattgtttttttttgattaagttaggttttttttgtttttttgatggtgtttttgtattagtgtgatttttagggttttttggttgggttagggtttgtttgttttttttggtgtttttggataggggtttttttttggttgtgttttggtttgaggagttttttggattgtgggaggggtgattgttgggtttgtgtggtttagaattttttttatgtgttgtttatatttttttttgtaaattgttagatttttgtttttttttttagtttagttttgtgtagttttgtttgttattggaggtaaattgggatagaaattgtgtttgttttttttttatagattgtatatgtaatttaatatttaaaagattttgagttttaggattatatatatatatatatatatatatatatatatatatatatatatataaatttaagtgtttattttgggaaaagttagatttttgttggatttttttatagatatttagtatttaatattatttttattttgaattaaatggggtgggaggtattattgtaattttattggggtttttggttgaattttttttttaattttattattttttttttttttatttttttttttgtttttttttaaaatatatattagttttgttttaaattttaatatttgtgtttgtgatagagttttttttaaggtttgaggtttagttaggttgtttattttttggtagatatagttaatgtttagtttttataaattaagattataaaaagtttatttttatatgtatttaatttttattaaatttaaattaattgtataaatttttttaggttatttagagttgttttttgggttgggatttgattaattagttattaggtattttattagttggggtttaagttgttttatataaatgttttttgttaatttgtttgtaattgaataaataaaaagggtataattattagtatagaggattaaaataaggagaggttaattttatttaaatatttttaaaatgttttaatttaataattatttaataataataattagaaggtatttatatattagttattttaaaagtttttgattatgttaaggaaagttttgggttgagatataattaagtgtgtatatttaaagtttgttattttgatagtagtattttttttttttggagttttagtttttttatttgtaaagttagttggttagaggtgatttttttttttgattttatatagatgtattttatgtatggttaaattaatttatgtatgttatttaaaaatggaataatatagaagggtaatttgattattttttatttttaattatttttagttgttttttttggtagtgaattgtatgtttaaataatgtatttttggtattatttttttttttaaaatttgaggtttgtttattaatattttaattaaataatatatgatttaaatttaaaagaattaaaagatttgttatgaaaagtttttttttttttttgatttaagttatttagttttttttgttgaaggtaaataatattgttagttttttatgtatattttagagatattttattggttgttattttttgatttgttatttttagttattttgttttaattttttgttatgatattagaaaattagggatataataattttgaatattttttttatattagggattataggaagttttatataaaattaataattaaaaaaatgaatttagtgggtagttgaaaattttgattttttttttttgtttttttgagatagagttttgtttttgttgtttaggttagagtgtagtggtgtgattttggtttattgtaatttttattttttgggtttaagtgatttttttgttttagttttttgagtagttgggattataggtgtatgttattatgtttagttaattttttgtatttttagtagagatggtgttttattatgttggttaggttggtttggaatttttgattttaggtgatttatttgttttggttttttaaagtgtagggagttattgtgtttagttaaattttgattttttttaattaataattaatttggaggtgtagatgttataatgtataaaaattgtttatttataaagagggtttatatgttgatttgagttttattttatttttttttgaatagaatttaaagtagtttatttgttattgttatggaattagatattatatttatagtggaggtatttttatttattggatgttttagtgtatatggtatttagtttaattatatttttttaaaaatttttttgtttttttatttttattaagtaagtttatttttttagtgaggggagtttttttttggtgtatatagttatgatagggttggggaaaatattgatgatattatttaataatttatatttaggtggttgggtgaggtggtatatgtttgtaattttagtattttgggaggttgaggtaggtggattatgaggttaggagtttgagattagtttggttaatatggtgaaattttgtttttattaaaattataaaaaatttagttgggtgtggtggtaggtgtttgtgattttagttatttaggaggttgaggtaggagtattatttgaatatgggaggtggaggttgtagtgagttgagaatgtgttattgtattttagtttaggtgatagagtaagattttattttaaaaataaaaataaaaataaaaaaataaataatttattaagggttgggattgagtattagattttagattgtagaaattttagttgagtatttatgtgggagggagttgagggttttggaatttttgatagaattttaaggtggtgattttgatttattgttgggagagatataaggagttattgtttttgggtttgggttgatttgttttgagttttatatatttttttagtgaattttttttgtagtaaaaaatatgggttggaagagagtgagtttagggaaatagaattatgttggatgagaatataaatatataggtttgttggtgtagtgagaaagaatatagaatatatataaagagatttgagttttaggttttattttgttttgtttgattttggtaagtttatttattttttagtggtttagtttttttaattttaatttgaagaaattgaattagatagtttagtagtttaaagttggtgaggatttatggaattttttgaaaatttgaagaaaattgtgtttttaatttagaaataaatgtatttttgtgtatttaaaatttttgttaatttgtagaagttatggattttttgatttaatttataaatttttgggttttaggttaggagtttttaaaattaggtaaattaaagggttttttttatgtgattatttaaatttagggttaaatatttataagtattgaattagtttagtaaatagggaagaattttattgaaggtaaaaataaagtgttaattagatgatgagttaattgttaataaggattttagatggttttgataaaattattttttagattaatagtttttgaagagatagtatggtggagtgaaaaaagtattatattaggggttataagttaggttaaaatttttttaattggttttgttaataggtagaattgagattttgagttgggatttttttgttttagtttttttttttttaatggtaaaatgagagggttgaattagatgatttttgaggttgttagttgtagtattatgtgagttaatgagtatagatattgggatgttttatgtttatatttattttggtttattttatttttttattttgtttgtgaaaagatagttgtataatttaagtagagttgggagaagggttattaagtatgttattttttgggtttttagaatttaggtttttaagattattggtagaaatgagattttttaaattattatgtgttattgaaaaaataaaaatatttatagtttgtaagtttaaaaataaatggtagggtgggtaggtgaggtggggtaaaattaaaatattttgttagattaaatagttttggtttagttaagttggtttattagtaggtttagagagatttagttttattagtaggtttgggggtagagggattgtggtttgttgtgggttgggtaaagtagtatttaaatttgttttagttttggttggagtttatagataagaaaatgttggttgggtgtggtggtttatgtttgtaattttagtattttgggaggttgaggtaggtagatttttttaggttaagagtttgagattagtttggttaatatggtgaaattttgtttttattaaaaaatataaaaattagttgggtgtggtggtatgtgtttgtagttttagttatttaggaggttgaggtaggagaattgtttgagtttgggaggtggaggttgtagtgagttgagattttgttattgtattttagtataggtgatagagtgagaatttattttaaaaaaaaaaaaaaaaaattaaaaaaaaaaaaagttaattagattatttgttttttgtttttagatttttatttttttatttttttgatttgtgttaatatttgtagttgtgagtttatttagtttttggggtttgagttattggttagattgtttaggtaaaatgattaaaatttggattatttttaatttttttatttttaattttttagaatttttgtttgttttatgttttttattttttagttgtttttgtttttggtattttattattgtttatggttttgtgtaggatggtttaattttttttattaattgtgttaggttaatgagggaagatttgtattttttggattgtaatagtagggtttttttattataagaggggttttaataatattgatttaaatattttatgttattattgttagatgtatgaaattttagtatgtgagttgggaagagtttttagagatttttttattggaaaatatgatattgtagttttagggatttaggtatttatattttttataatttttttgtaaaaaattatgattttttgtttagagtgaggaaaagtttttttataagtattgtttttttaattaaagtgttttatattggagtttgggtatatattttgaaatataaattttatgttaatttttattttattaaaggtggtatatattttgtattttatgttaataatatatttttgattgttttgttaaatatggatgtgagtttgatagtttggattgttgtaataaatagtataagtaaggtggtttaaataatggtttattttttatagttttggaggttgttaagttaaagattaaggtggttatatatttgatgtttggtaagggttttttttttggtttatagatggttatttttttattgtgtttttatgtggttaagagaaggagagattattttttttatgttttttttttaaagggtatgaatataatttatgagagtttatttttatgatttaattattttttataggttttaattataaatattattatattggggattggagttttaatatattaattttgggggtatataaatatttagtttatgagtttgtgtgtgtgtatatttatatattattgtgtgttatggagtagattgatgtagtatttagaatttttggttataattgtagttttgtatattgatatgtggtttataagaataagtagtttaatttggaaataaattttaatgtaatagttttgttgtagggtaaagatgataattaaaaggaatttagttaatatgtggtaaataataataaaatgatttttttattaattattttaggagaatagttatttaataaatatttgaatttgagttagtgaatgagttgtttttgtttattattttttttatgatattttgttttttaaaaggtgaaggaaagaaatgaattttattttattttttttttggagataggattttattttgttttttaggttggggtgttgtggtatgattgtagtttattgtagtttttagaagagttgagtatttttaaagatttttatttgatttaatataaaataaatagaatgattaaaatgattatgaggttgattatgtttgtaattttagtattttgggaggttggggtgggtgaattatttggggttaggagtttaagattagtttggttaatagggtgaaatttagtttttattaaaaatataaaaattagttaggtatggtggtgggtgtttgtaatttttgtagtgtatagtttattgtagttttaagtttttggttttaagtgatttttttattttgttttttttatgtgttgagattataggtgtgagttattgtaatttgttaagaaaggagttttaaaaggtatgtagtgtttatatatttaaaatatttttttttttaaaatgttttatatatttatgtaaagtgtatgtattatattatatattttataaattaggtattaggaagttaaataatttgttaagttaaataatgaataaatgttagaatttaggagttaaaattagaatggtttgttttgagagtggtgttaagtttatttttgtagaagaaaatggatttgtgtttttaaggttgaaatttgaagggtttttatgtgaaagaaggtttatttttgttttatggggttttaggggtgtagttagataggaaataagttatagagagaaaaagattttagttttttttaaggaagaaggttttggtagttgatatagttgaaggtgagggttgtgttgtgagtttgtgtttgaggatttgagtagagattttagtgagttatattgttagggagagtgggggtagtgagatgatatttttttttattttgagagttgatgttgttataaatgattgtttatttttagagtttattggtgtaaaatataaaggtattagtttattaaaaaaatttataatttttttaaagtagtatggaatataaatattattttaatagttttatttttttaatttgtttttggaatattaagatatagatttaaagttgatattgataaaaatattaggttttgtttttttattaatttattatattagaaaaatttaggttaggtgtaattgtttatattttttttgggaggttaaggtaggtagattatttgagtttagtttaaggttattttgggtaattatgtttataaaaaatgtaaatattatttgggtatggtggtgtatgtttgtggttttagttatttaggaagttgaggtagtaggattgtttaagtttgggagattgaagttgtagtgagttgtgattgtgttattatattttaatttgggtggtagagtaagattttgttttaaagaaagaaaaaaaaaagtaaagtaaaataaaaaaatttaaatattttttagtttatagtgttagtatagggagaattgaagattttagaggaaatgttattgttatttaaaaatggttttgtggagtaggaattagattgagggtttttattgttttttgtttgttggtttggttttatttttttttttatttttagttgaggtaggtaaattgtttgagtataggagtttaaggtaagtttgggtaatatggtgagattttatttttataaaaaatttaaaaaataagttgggtttggtggtgtgtatttgttattttagttatttgggaggttaaggtggaagaattgtttgggtttaggaggttgaggttgtatgtagttattatgtttatgttattgtattttagtttgggtgatagagtgagattttttgtttttttagttttgtttttttgtttttttttttttgattatagagtgttatagtgtttgtgaagtttattgattatttttagttttttatttgagtttttgagtatttagaagtaataggttatatagaaagttttaaaataggttggttgtagtggtttatatttgtaattttagtaatttgggaggttgaggtaggtagattatttgaggttaggagtttgagattagtttggttattatggtgaaattttttttttattaaaaatataaaatttagttaggtgtggtggtgtatatttatagttttagttatttaggaggttgaggtatgagaattgtttgaattgggaggaggtagaggttgtagtgagtggagattgtgttattgtattttagtttgggtaatagagtgaggttttgttttaaaaaaaaaaaaaaaaaaaagaaaagaaaaagaaaagaaagaaagaaagttttaagatagggtttaattatataaatttagtttaaatatatatttagggtatttgtaaggtgaaaatatttaaaataagaaaaggtgttttggaagtttttattatttggtgttaagaaaaaaagtattttagtaattaaatttagaattgtgttgggtttttttttttgtattttatgttgtagtatttttgtttttaattatatataggggaaaggataataaagtatttgatgttgagtatttttaaagatttttatttgatttaatataaaataaatagaatgattaaaatgattatgaggttgattatgtttgtaattttagtattttgggaggttgaggtgggtgaattattttaggttaggagtttgagatttggttaatagggtgaaatttagtttttattaaaaatataaaaattagttaggtatggtggtgggtgtttgtaattttagttatttgggaggttgaggtaggagaattatttgaatttagaaggtagtggttgtagtgagttgaaattgtgttattgtattttagttttggtgatagagtgagagtttgttttaaaataaataaataaaatgattatgaatattttgaagtgtatatttatttattttttttaattggtttttagattatagatatgtatgatgtatgatgtgatattttgaaatatgtatgtattgtggaatggttaaatagaattaaataatgtttgtgtgattttatatatttattattttttgtagtgagaatattttaaaatttatttttttaaagagatttttaagaataaaatatattgttatgagttatatttattgtgttgtataatagattttttgaatttattttttttaattggaattttgtattttttgattaatatttttgttaattgtttttttttagtaattattttagtttttgataattattattttatttattgtttttatgagtttaattttttgagattttatatgtag

SEQ ID NO: 78 - DNA, 21430 bp, Artificial Sequence
  chemically treated genomic DNA (Homo sapiens)
ttatgtatggaattttaaaaagttgaatttatagaagtagtgagtaaaatggtggttattaggggttagggtggttattggggaggagtggttggtggggatgttggttaaaagatataaaattttagttaggagaaataagtttaagagatttattgtataatatggtgaatatagtttataataatgtattttatttttgaaaatttttttaagagagtggattttaaagtgtttttattatagaaaatggtaagtatatgaggttatatagatattatttagttttatttggttattttataatgtatatatattttaaaatattatgttgtatattatatatatttataatttgggggttaattaaaagaaataaataaatgtgtattttagggtatttataattattttatttatttattttgaaatagatttttattttgttattaaggttggagtgtagtggtgtaattttagtttattgtaattgttgttttttgagtttaaatgatttttttgttttagttttttgagtagttgggattataggtgtttgttattatgtttggttaatttttgtatttttagtggagattgagttttgttttgttggttaagttttgaatttttgatttgaggtgatttatttattttagttttttaaagtgttgggattataagtatgattagttttataattattttaattattttatttattttatgttgggttaaatgaagatttttagaagtgtttagtattaaatattttgttatttttttttttgtatgtaattaaaaataaaaatattataatataaaatataggagaggaggtttagtataattttgaatttgattattaggatgtttttttttttaatattaaatagtgaagatttttaaagtatttttttttattttgggtatttttgttttgtaagtattttaagtgtatgtttaggttgagtttatgtgattaagttttgttttagagtttttttttttttttttttttttttttttttttttttttttttttttttgagatggagttttattttgttgtttaggttggagtgtagtgatgtaatttttgtttattgtaatttttgtttttttttagtttaagtaatttttatgttttagttttttgagtagttgggattataggtgtgtattattatatttggttaaattttgtatttttagtagagaaggggttttattatagtggttaggttggttttaaatttttggttttaagtgatttgtttgttttggttttttaaattgttgggattatgggtatgaattattgtgattggtttattttagagttttttgtatagtttgttgtttttggatatttaaaggtttaaatgaaaaattaaaaatagttagtaagttttgtaagtattatgatattttgtgattaggaaaaaggagataagggggtaaaattgaggagatagaaggttttattttgttatttaggttggagtgtagtggtataaatatgatgattgtatgtagttttaattttttgggtttaagtaatttttttattttagttttttaagtagttgggatgataggtgtatattattaggtttggtttattttttaaattttttgtagagatagggttttattatgttgtttaggtttgttttgaatttttgtgtttaagtaatttgtttgttttggttaaaagtgggagagaagataaagttaggttagtagataaaaggtaatgaaggtttttaatttagtttttattttataaaattatttttaaatgatagtgatattttttttgaagtttttagttttttttatgttaatattatagattgaaaagtatttgaatttttttgttttgttttgtttttttttttttttttttgggatagggttttgttttgttgtttaggttggagtgtagtggtataattatagtttattatagttttaattttttgggtttaagtaattttgttgttttagttttttgagtaattgggattataggtatgtgttattatgtttagataatgtttgtattttttgtagatatggttgtttagggtggttttgaattgaatttaagtgatttgtttgttttggttttttaaaggaggtgtgagtgattgtatttggtttgagtttttttaatatagtaagttgataaaggaatagaatttaatatttttattagtattaattttaaatttatattttggtattttaaagataaattgaaaaagtaaaattattaaaataatatttatattttatgttattttaaggaagttgtaagtttttttgatgagttagtatttttatattttatattagtgggttttaggaatgaataattatttatagtagtattagtttttaggatggaaagagatgttattttgttgtttttattttttttgatagtataatttattagaatttttgtttaaatttttagatatgggtttatagtatggtttttgtttttaattgtgttgattgttagagtttttttttttgaaaggagttgaaatttttttttttttgtgatttattttttatttagttatatttttggggttttataaaataaaagtaagtttttttttatataaaagttttttagattttggttttaaaaatataagtttatttttttttataggagtaagtttgatattatttttaaggtagattattttggttttaatttttaggttttagtatttatttgttgtttgatttgataagttatttaattttttggtgtttaatttataaaatgtgtaatataatatatatattttatataggtatataaaatattttagaaagggaagtattttgaatatatgaatattgtatattttttaaaattttttttttggtaagttatggtggtttatatttgtaattttaatatgtagggagggtaaggtgggaggattatttgaggttaggagtttgaggttgtagtgagttatgtattgtagggattataggtgtttattattatgtttggttaatttttgtatttttagtagagattgggttttgttttgttggttaggttggttttgaatttttgattttaggtgatttatttgttttagttttttaaagtgttgggattataagtatgattggttttataattattttagttattttatttattttatgttgggttaaataaagatttttagaagtgtttagtttttttaaaggttgtagtgagttataattatgttataatattttagtttgggagatagaatgagattttgtttttaaaagaaaaatgaaataaaatttattttttttttttgttttttgagggatagggtgttatgaggaggatagtaagtaagaataatttatttattgatttaagtttaaatatttgttaaatagttgtttttttaaagtgattggtagaaaagttgttttattgttatttattatatattaattaaattttttttagttattatttttgttttataataaaattgttgtattagaatttatttttaaattgggttatttgtttttatgagttatatgttagtgtgtagaattgtggttgtaattaaaggttttgaatattgtattaatttattttatgatatatagtagtgtgtggatgtgtatatatataagtttgtagattgaatgtttgtgtatttttaaaattaatatgttgaagttttaatttttagtgtgatggtatttgtagttggggtttgtgggaggtaattaggttataaggatggatttttatgaattgtgtttgtgttttttgaagaagagatatgagagaaatggttttttttttttttggttatgtgaggatatagtgagaaggtggttatttgtaaattaagaaaagggtttttgttagatattgaatatgtggttattttaatttttaatttagtagtttttagaattgtgaggaataaattgttgtttaagttattttgtttgtgttatttgttatagtagtttaagttgttaagtttatgtttatgtttggtaaaatagttagagatgtgttgttgatatggaatgtaaaatatatattatttttaatgaaataaaaattgatataagatttgtgttttagagtatatatttagattttaatgtaaggtattttggttgaaaaaataatatttataagaaaatttttttttattttgggtaagaaattataattttttgtagggagattgtgaaaaatatagatatttgggtttttagaattgtaatgttatattttttagtgagaggatttttaagaattttttttagtttatatgttaggattttatatgtttaatggtgataatataaaatatttgagttaatattattaaagttttttttgtgatggaaaaattttattgttatagtttaagaaatataggtttttttttattaatttaatataattaatagaagagattgggttattttatataaagttataagtggtagtaaaatgttaaaggtaaaaataattaagaagtaaaaagtatagaatagatagaagttttggagagttggggatggaagaattgaaggtaatttaagttttaattattttatttgggtaatttgattagtaatttagattttaaaggttgaatgagtttatagttgtaaatattaatataagttaggaggatagaaaaatgaaggtttgagagtagagaataagtggtttggttagttttttttttttttaattttttttttttttttttgagatgaatttttattttgttatttatgttgaagtgtagtggtaggattttaatttattgtaatttttgttttttgggtttaagtaatttttttgttttagttttttgagtagttgggattataggtatatgttattatgtttagttaatttttgtattttttagtagagatagggttttattatgttggttaggttggttttaaatttttggtttgaagagatttgtttgttttggttttttaaagtgttaagattataggtgtaagttattatgtttagttagtatttttttgtttgtggattttagttagagttggggtaggtttgggtattattttgtttagtttataataaattatagtttttttgtttttagatttattgatggggttgggtttttttagatttattgataaattagtttggttaagttaggattatttagtttaataaaatgttttaattttattttattttatttatttattttgttatttatttttaaatttataaattgtgagtatttttatttttttaatggtgtgtaatgatttgggggattttgtttttgttaatgattttagaagtttgaattttgggaatttaagagatagtatatttgatagttttttttttagttttatttggattgtataattatttttttataaataaaatagaaaaataaaataagttaaaataaatataaatataagatattttagtgtttatgtttattagtttatataatgttatagttggtagttttagagattgtttggtttaatttttttattttattattagggaaagaagggttagggtagggaagttttagtttaaaattttaattttgtttgttggtagaattggttaaaaaaattttaatttagtttatgatttttgatgtggtgttttttttattttattatgttgtttttttggagattattgatttgaaaaataattttgttaaagttatttggagtttttattggtaattggtttattatttaattggtattttatttttgtttttagtaaaatttttttttgtttgttaaattggtttagtgtttataagtatttgattttaaatttggatggttatataaagaaagttttttagtttgtttagttttgggggtttttaatttgggatttaggaatttatgggttgagttaggggatttatgatttttataagttagtaaaaattttgagtgtataaaggtgtatttatttttgggttagggatatagttttttttaaatttttaagggattttatgagtttttattaattttgaattattgaattatttagtttgatttttttaagttagagttgaggaaattgagttattgagaagtgaatagatttgttaagattaaatagaatagagtaaagtttagaatttagatttttttgtgtatattttatatttttttttattatattagtaggtttgtgtatttgtatttttatttgatatgattttgtttttttgagtttatttttttttaatttatgttttttgttataagaggaatttattgaaggggtatgtagggtttaaaataaattaatttaagtttaggaatagtggttttttgtattttttttagtagtaagttaagattattattttggagttttgttaaagattttgaggtttttggtttttttttatgtgggtgtttagttggagtttttgtagtttggagtttggtgtttaattttaatttttggtgaattatttgtttttttatttttatttttatttttgagatggagttttgttttgttatttgggttggagtgtagtggtgtatttttagtttattgtaatttttgttttttgtatttaagtgatatttttgttttagttttttgagtagttgggattataggtgtttgttattatgtttagttaagttttttgtaattttaatagagatggggttttattatgttggttaggttggttttaaatttttgattttatgatttgtttgttttggttttttaaagtgttgggattataggtatgtgttattttgtttagttatttaggtgtgaattattaagtgatgttattaatgttttttttagttttgttatagttgtgtatattaaaggaaaattttttttattagagaagtgggtttatttggtggagatgaaggagtaaagagatttttaaggaaatgtagttaaattaagtattatatgtattgaagtatttagtagataaaggtatttttattataaatatagtgtttaattttatagtaataatagataggttgttttgaattttatttagaaggaggtgggatagaatttaaattaatatataaattttttttatgagtaggtagtttttatatattatgatgtttgtatttttaaattaattgttagttaaaaaaaattagaatttggttaggtatggtgattttttgtattttgggaggttgaggtaggtggattatttgaggttaggagttttagattagtttgattaatatgatgaaatgttatttttattaaaaatatgaaaaattagttgggtatggtggtgtgtatttgtaattttagttatttaggaggttgaggtaggagaattatttgaatttaggagatggaggttgtagtgagttaagattgtattattgtattttagtttgggtaataagagtaaaattttgttttaaaaaaataaagaaaaaaaattagaatttttaattgtttattgaatttatttttttaattattgattttatataaaattttttatgatttttggtgtggaaagaatatttaagattattatatttttaattttttgatattatagtaagaagttaaaatagaatgattaagaatgataaattaagaaatggtagttaataaaatatttttggaatatatataagaaattgataatgttgtttatttttaataaagagaattgagtgatttgggttaaggaagaagaaagattttttatggtaaattttttagtttttttgaatttgaattatgtattatttaattaaagtattaataaataaattttgaattttgagaaaagaaatagtgttaaagatatattatttagatatgtaatttattattagaagaagtaattaaaaatggttgagggtgggggatggttaaattgtttttttgtattattttatttttaaatgatatgtataaattaatttgattatatataaaatgtatttatataaaattagaaaagaaaattatttttaattaattggttttataggtaaagaaattgaggttttaaggggaggagatattattattaaggtgatagattttagatgtatatatttggttgtgttttagtttagagttttttttaatatggttagggatttttggagtggttggtgtgtaaatgttttttaattattattattagatgattattagattaagatattttaaggatatttgaataaaattgatttttttttattttgattttttgtgttaataattatattttttttatttatttaattataagtaaattgataggagatatttatatgaggtagtttaaattttagttaatggagtgtttaatgattaattgattagattttaatttagagagtagttttgagtggtttaaaggaatttatgtaattagtttaggtttggtagaaattgagtgtatatgaaagtaagttttttatggttttgatttatgagggttggatattaattatatttgttaagaggtgagtagtttagttaagttttaggttttgggggaggttttgttataggtatggatgttgggatttggagtaggattgatgtgtgttttgggagggagtgggaaggaaagtgggggaaagaaagatggtgaaattagagaagggatttggttagagattttaatgaaattatggtggtgttttttattttatttaatttaaagtaaaaataatattaaatgttaaatatttataaagaagtttaataaaaatttgattttttttaggatgaatatttgaatttgtgtgtgtgtgtgtgtgtgtgtgtgtgtgtgtgtgtgtgtgtgtgtaattttaaaatttaaaattttttaaatattaaattatatatatagtttataaaaagagagtgagtgtagtttttgttttagtttgtttttagtggtaggtaaggttgtgtagggttgaattgagggagggggtagaaatttgatagtttataaagaaaggtataagtaatgtgtggggaggattttgagttgtgtggatttggtaattgttttttttgtggtttaggggattttttaggttgggatgtagttgaagggaagtttttatttggaggtgttgggaggagtgggtgaattttgatttagttggggagttttgggagttgtgttagtgtggaagtgttgttgggggaataggggaaatttgatttgattggaaaagagtgattgaaggggagattaatttgtttgttggggtttttgttggttttgtttgtttgttggggtggggttattgtgggggtttttgttgttttgtggaagagaggaaagaggggaaggtgattttgtgtgtgtttggggatgtgggtttttttgttttggtatatgggggttagagttttgtgtttgtgaggttggagggaagttaagaggggttgagtgagagatatgtgaatagatgtatatagataggatgggagatgtgagtggtgtgtgggatataaaggtgtggaggttttgaagtttggtgaggatagtgggtgtttttggtttttattattttttttgtttgtgttgtttaatttggtgttaaattggatttatttgttttttttttatttttaggtggtttgtttttttattttagttagaggtgattttatttgagaatggaagaagtaaaggtattgggtttttgttaggtttttttattaaatggttgtgtttatgatttgttttgggtaagttatataaattttttatgtttttatgtttttatttgtaaaatggaattaaaaattgtatttatttatggtgttgtttaggaattaataaatgaatgtgttaaagtgtttggaatagtattttgtataggggaattttgttatatgttttagatattattattagttatttatttagtaaatatttgtagagtgtttgttttgtgtgaggttttgtgttgagtttagggaggtaggggtgaattgggtaggtgttattaggtagttttaaagattaggaaagaaataaaatgggtggtgtgataatgtgattggagaagagttgttttaggtaaaaggagttagttaagtttgttttgttttttaggttttattgttttttttgatttaaaaaataaaaataaataaataaataaataaataaataaatatggtttttaggtgttttgtttttttggtttaaatattttggtgttggggttaaaaagtgggaatagggtggggaagggatgtttgttgggaaggaggaggagtttaagatttttgttttttttttgttttttggtgttttgtttttttttgggaggaggagtagtgtgaagtttggagtttttgaaaaggttgaatggtgtttgggattttgttagggaggaggttttgggtttttggagttgttgattggggttaagttttttagtgggagttatgtatttgtattaggtatttttagggagagaatattttgttttttgtgtagttgggatgtatagtgtgtaaagtggttttttttaagtttttgttttgtttgtgataattattttgagagttgataggtattgttattttgattagattgtggtttatagagggaaaatgttgattttatttgattttaagttttgaatttgttttataatagtgtttttatttttttgagtataaaaaatgttttaaagtaatgaaatatttattaatgtttattatgtgttaggttttggttttatgtgattttatttaattattagagtaattttgagagagttttttttttagtttttttagttttatagatgaggatattgagggttagagtagtaaggttatttaagtaagagatggagtagttattttattttaggtgtgtttattttagagttggagttgtttttattttaggaggatagtaaaagaattggaatttaaatgttaggtatattgggtagggtagtggttattttttggttttttttttttggttttttttttaggttttaagggttatgttatagagtattttttgtgtatttataattattaaagggtgaagtatagttttttttatttaaataagaaggatattggttattttgaatgaaagtttgtgatgtagattattgttttgttttgatttttatttttagggagatttgtttatttttgatggttttgtttttttttatagttttttgaatttagaggggatttggttggaaggggtgtttttattttataaaataaaaatttaatttatttatttaatagatatttagtgtttgttattttaggttagattttgagtagagtgttggatatgaagtagtgaataaaattgagattatttaggtatatagagaggaagttgttggttagagataatattgtttaggagtttaggatttttgttattaagttttgtttattagggttttagttatgttggaatgtgtatgtttagtttattttagatgaagtttttgttttagttaggtagtttttaaagttttattttttggaggtttgatgtaggtttttatgtaaatatttttaaatattgattttatttttttttggtataagttaaagaaatttttagttgagttttggattgtatgtgttgtaagttgatagaattaggaaaatgaaaatttgttttaggtgattttaggaaatatttttaattattttttaaaataaatttggggaagttttatagttggtagtagaggtttagagaggtgatatgatttgtttaaggttatatggtttggatgtatattagttttgtgtaaattttagatttgttagtattatttttttttttttgagaggtttgtgtttttgttagatgagtggtaaaggtgattatataattttggggaaattatatttttagttgttttttgaagtaagttgaagagtgaggtgatggtgttgttttggtgtatttaggaggagggaaagggtggagtgttttgttgattgggttgtagttttggtttgtatgtaggaattggtgaaaatatttttgtgtattattgttttaggtgtttgaagaagattaggtttagaggtatggtttggagattggatttagtgttattggattgttttggagtagattttgtgtttaggaggtagttttttttattttttttgtaaaagttttttaaatttttgtagttgttaattaaaagaaaaaaaaagattaaataaataatggtagagaattttttgaaaagaggatggaggtagatttttggttttttttagagtttgaatatgtgaaggttttttttatttgtaggaaattttgtagtttgtaaaagtgtgtttttttggagtgttttgttttggtgtgggatgtttatggttgttttttttgtagtttggttgggtttttgttttgtgttttatattattataggtaattaatattgtattagttgtattttaaatttttaaaatttataatataatgtaatggtataagggtatttattattaaaggatatttgatggagagggaggtggaggaattgttggggttgttgtgtaaggtgggggtaaagggttgaggtttagggagttgggggagatttgtaagttagtttatgtggtagggggtgttgtattgtgtggagggtaaatttattttgttttgaattttggttttgtggtttgatgatttgtaattttttgaggatgaagtagggaaatgtgtagatgatttttggatttggagtattaaattttaaattaggaaggtgtttttatagtttgtaaataaaaagagggagtgtaaagagaatagggagttggtgtttatggagtatttattatgtatagggtattatgttaggtgttttgtagtagttatagtagtatttttataaagaagttgaggtggattttagagtgaataataatttggatgagaattttagatgaatttggaattttgagtgggttttattagagtgttttagtgaatatttttttttttttttgtttttattattttatttttttttaagttttttgaattttttaaaataatttgttgtttataaaatttaagtattagttgatgttttaaataaataattttatttagttttgataataattttgtgaaataagtgttggtttttttattttgtagataagtaattttgttggagaaggtttagagaaattaagaaattagttttaggatggttttgttagtgagtagaggtattggaggtttgaatttttattagtttggttttaaagtttattagttaagttaaattgagtagagttttatgatggtaggtagggaagtatggaaggaagtgttttgaaattttaagtttagatataagttgtagggttttttatgaggagttttaagtgagtttgttatggaagaggagtggggagaagggatggttgggggttgggtagtagaaattgatagtttaattttttggggtttttttttttaaattttttttaaagttagtattttttagtttttgagaaaaaataaaattattttgatttgggttgaaaaataaagtatttattttagaagttaatttaaggggtaaagggaaaagaaaatttaatattttatttgtatttatttagagaatgaaattaaaggttatatagtaatatataaattatatgaaataatgaaaaaataaaataaaatttgggttagaggggtagggtgagaagggtttaggtttatggttttatttttttttttttataaaattataagtgaatttttattgaaagatatttatataaagggaatggaaagaagtagaattaaataaataatagtaatgaatgatgttaataataatagtaataataaaagtgtaaggaggttagatgtgttgaaaggatttgtatataatgtagagaagttatagttgttttttagtagttgattgtatgttgagttggtaatttggtaagagtagtgagttggggttagagagtttttaatggttatgaatattataaatttttgttttttagtaagtagtaattattttttaaatattagtaggtagtgaaagatggttagagttggtgttggtagttgattataaatagttaagtgattttagaatttttagttgttagattgggtttatttgttttggagttttatttattatgaaaaaatggtaatttggagtttgtaattttttgtatattttttttgaatttaatttttatgttattttatgagaatttatgttaaattaaaggataaggtgaatagaatttaggtaaggaagggagtataaggttattttttggaaatatatatgtattttatatattttaataaatttttagtgtatgtttgtgttttttttagatattttagattttgtgttattattgattattttttttttatttttttattttttgtttaattgtgtttagtaaagtggtatttttattttagttttgggtggttgggttaattgattgttttttgttttggggtttttgttttgaagttgtgtggtttttgtgtgagggtaaattttagtattatggatagtataagtatatttaggtttgtttttttgtaatatttttttagtgttaaaatttttttggtgggaatagaaaggaaagagagagaaggttggaggtaattaggtgggataaagggggaaagtttgtggttttggaggagagagtttaatttgtttaggaaatgttttggagtttttgataattattttttgaatttgggagggatgagtattaggtttttttggtttttgatgttgtgttttgttgtaattagtggatagttgaatattttatttgtttttgtttttgtttttggttgtagaattagatttttattatgttttttttaaggtttagttttttagtgatggttgtgatttttttagatgaaggatgtggttggatagtgaaataggttttgagtgaatgtttttttggtgttgtgatggatgtgtgtttgtgtttttgtttgttgttgttgaagagttttggtttgttgttttttttttggtaggtggttttggttttttttaattaggtttggagtattggtttgagagtgattatgttgttgtgtgagagagtgagagatttgaatttgtagatggtgttttggtttagtgagtttatgttggggattttgagattagttagagttgtgtttatgtttgtttgggttatttttagtttgatgtgttgttgtttgaagtgtttggtgaaggtttttagtttgtgtgggtttgattttatgttgttgaggtatgtaggtatggtgttatgaggggttatggtgtgtgggtgatttatgtttatggtttggtgtaggtggtttatggtgtttaggtggtgtggatggatttgtgtgggtattattgagtgttttggagtgtttaggttgtttatatttagtgtgggtgagatgtgttttagtaggttgtttttgaggttttggtgtatggtgtggtgagggtgtgaggtgagtgtagttgggtgggagatgggtatggtggatgaagtggatgtgtagggtatgttgtttatggtatggtaggtggtgttgggtttgaatggatggtttttgttgtgggagatgatatttattgttgttagagttttggtgtgtgttagtaggtttttattaaagtttttaaatatattattttgtagttgtaagtgagaaggtgtatagtatggttagtagggaatattgttaatataggattaaaatatatttttaagtaattgagatgtttttttttaaagtttaggttataaaaattaatatggaggtagtggttttgttggaatagatgtgtggattagagatatgaatgagagagagagtgtgttgggagagaatgtgggggagataaggagaggggtttagatagtggtgattgttttgggtgatatgaaaaaaatatgaagttagtgtttgttaaaaaatgtgttttagagtggtaattatgttttattatgtatttgtggggttgggagatagatttggtgtatggttttggagttagagtgtagattggagaatttgggtttttgtagtattgggtgtatgttgaaaggttgtttggagtttatggttattatttttgtgtttttggtagggtggtagtgggtgatatggaattaggtttgtttagtttgtttgttgttttttaagtgagtgttgtttagtgtttgtgttttttttgtttttttgtttgttgtttttttttttttttatttgtttttttatttattttataagtagtttgttaggaagggtttgggtgtgtgtaggtgtgtttatgtgttggggatttgtaggggtggtttgggaggtgaggagagatagtagttagtggtgtgtttttttgtgtttgtggtggttgttttttttatagtttttatatttgggtttggtttggttttttttagtttgttttgttttgttggttttaatttgttagatttttttgatttttttttttttgtggatttttttttttttatgttattttaaaagttttaatttttttgttttgttttagtttgaattgtttggataaaagggtagttttgggttgagttggggtaggaagttgattttattttaattttttttttttattatatatatatatatatatatatatatatatatatatatatattttgttggtttggttgttgttaaattgtttatttttagggtgtttttggttttatgtttaagttgtttattagagtttggttttgtggtgtagtgaggaggtgtttttaagtgtttagatgggttttggagagggtgaggggttgttagaatgaggtttaggtgatttttgttttattttttttaattgtgttttggggtagaggtaggggtagtaattgtttttttagtttggggtggttttttttttatgtttgttttttttttttttatttgagggatgtaatttggtttattttttttttaatttttttgtttaaggaagtttgtggagtattttttttagaatagtgattgtttaggatggttttttaggtttgggagttttttagtgtatttttgttgggtagttagagtttgtaagtttattttttgtgataatagttattgtttaagagtttttaatatgtgttagataatttagagtttgtttatgggatttttatatttattgtatggagtaggtgatgttattttgttttatagatgaggaaaataaggattagaggggttaatgattagtttatttatttatttatttagttatttatttattttataaatatttattgatggtttgttgttttttaggtgttttagttttttggtttttttttttaaagttttggaatttgagggtttttgaggttagtattgtttgtttttattttttttagtttttttttttttttattttttttttttttttttttttttgttttgttttagtaaatattgtgaataatggatggggaattttggattttgattatgttgtattttggtttggagagaaattttgtgtgtgtagttgtatttttttgttagggttattgtttttgttgagagagtgatttttggggtttagagattttattttgtttgttattgtgtagggtatgtgtgtgttgggttttttagaatttgaatgaggtggggtggtgtggtttaggggaatattttttagtttaagaggatgttttgatagatttgggtttttttttttttttggtgttttttagttgtttttttttttatttgagttagttttttttgttggtttttgttttgtgatggtgggaaaaagatttagtttaggtgtttagagttaagtgtaatttttttgttaaagttttttgagttttggttttggtggtttttaaatggaattgtattattgtttgtttttttggattttggtgaagatgtttagagttagggtaagaagaaaagtattgagttatgaaattggtgtttagtaaatttttttataatttggtgttatagtgtttaggttttggttttagatttaaaatgtgtttttgttttttgttggttgagattatgagatatttttaatttttttgtattgtggtgtttttatttgtaaaatgggggtgattatttattttttattgattgttgtgaggaatgtattgggataagtatatggtatagtgtttggtgtattgatattattgaatatatgtttttttttttttttttaatttaaagagaaagtatgtgagagtgggggtgggttaagttatttttttggaatttggtttgtttgtatgtgtatattgtggatttttgttttttatttatttaatatttgtattgtgttagattttatgttaaaggttgggatatagatgtgaattagaatttattttggtatttaaggagttattagtttaatatttattttagaaagttaattttaaatttgttaagtagtagaagggaggtagatttatgaataagatatagagtataagggtggtaggattttagaagtgtagaatatatattagaattatgggttgtaggagggttggatttggggttgtattttgatatggagtatgggtgattttgattggattttagtttatttataaggagtgggttgtataagatgattgttaagttttaataagatttttagttttaataagattattattttggttaatttgaatgaaatatattttgagtatgttaggaatttatttttagagatatttaattttttagagttgaatgtagtattttattatttattaggatttaagattagtttttgttttttttttaatgttggaagtttaaagggaaaaggggaatgaaatatagggatatattggtttgtattttgtttggttttatgatgttttgagatttataattattttataatattttagttgtttgtgaagttgaatttttagaaattgggagagaaaggatttatatttattttttttttttgttttgtttttttaggggtttgggagatattggttagtatagaggttaggtatgagttagaaatagagtaaaattaattggtttttatatgtttttaatgttgatttttattttattagtttttattttagtatttttaggtattaggattatatattaagaaatatatttgtgtttggttttatgtgttttagggttttttttatttttttttttaagaaggtttattggtagttttaggtagttagtggtaagataatatttatttttaaggattagtttttttgagaaggttttggagataatagattggagattggagaagaaaagagggaaaagattatagaaaaagtaattggaaggatagttttagatggtaatttgtaatagtttttatgttttttagaatttgtaaatttaaattttataaggtgtaaaattagtaaaataaaattgagtaattttatttgggtggataaaaggaaagattgaaattgtggtaaattagagagtatttatttatttttttttttattattatggtattaaattataattatatatatatatatatatatatatatatatatatatatttatattatttatgggttaaataaaatatgtgaaggtttatgtaaggattatgtgggtatttatgtaagtggtattgaaggaagaattttttttatttgataagtatttttaaatatttattaatagtagagttttgtggaaggttttgaagatatagaagatattgttttaggagtttagagtttagtagggatatagatttgttatatgtaaggtgaagttagggtataaagtattatattttttagaaggattagttttgtagagatgtaaagggggtaggggtttgggggtagatgtatttttttgtgtgttagtggtttttaattttagtatgtgtaggaattatttgtaattttttaaaatatagtattataggtttatatttagagatgttgattttaaaaattaatgtgttttttaatagatatttatgattttggatgtagaggatttgggattttgaatttgaaaaatttagtttatatttttgttatttggattattattattattattattattattattattattttaaaattttgttttaattatgtaagttttatggagatttaaagagagttttttttttttgagtttttaatgttttttgtatttttttttattattttttagtaagaatgtggtgttttatgatttttgttttttgaagaattgtttgtgtttttagtgtttatgtttataggttaggtaatattaagagtttgatgtaatttatgttgaattaatgaattttggttaggggggtgtttatgatgatggtgataagaagggttatttatggagtggtttttatgtataaggttttgagttagatgttttggaagtgttgtatattgagtttttaaattaagtttgtgaggttgatattattatttttattttatagatgaaaaaaaggaggtatagaaagattaagtaagttgtttaaggttatatagttaggtagtagtagtatggggaagggagttttggtttatttgattttggagtttaggttagttttaattaatattttgggttggtattagttattttattttttaagtttagggtttgagggagtagggtgagtaggttttatttttttttttgtttttggaggttggttaggttttaggtatgtttttgggtataggttgtatttggagaagttagtagttatttttatttatttttatttttaagttttatattggagagttggaaaaggggtagggagggtggaatgggatatggttttgataggagggtttgaatttaagatgttattgtgtagtgaggtagttggtggggttgtttggttaggtgtttgtagttgtttgatttgtttttttttttttttttttggttgttttttataaattttttatatgtatttgttgtttgtgtagttgttgtgggatttgtttgttggttgttgttttgtattgtttgtaaagtggtttagaggatttgagatgtttagagggatttaggggttagaggttgagtgtttgtgagggtttggtatgtgttaggagttttttttttttttttagatgttttgttatggatatagttttgggatttaggtagtaggattttaaataggtttttgtttttttagtttttttatttgaaaaaatgagtggatttagttg

SEQ ID NO: 79 - DNA, 26652 bp, Artificial Sequence
  chemically treated genomic DNA (Homo sapiens)
gtgggtatgtgtgtgtgagagagattgagtatttttttgtaattttttattttgtttgtttttaggtgttgttatatgaaatttttgaattgaggatttttattagtttttttaggatttaaggatatagttttggttataaatggtgttagttttggtgggggagttgttgttgttttatttgggtttaataaattttattaaattgttgtgtagttagtttttagtgttaagtggaaatgtttggagtttaatgttggtatttagtttatagttttgtttgttttttttttttttgttattttttttattttttaaatttaggtattaatttttttttaatatttattaataagggttgggtttttaatgggtagtgtttatgaagtaagggagatttttatatagagtgaatatggtatgggggtggggaggttagggttatagaggattgtgtttttttttttattgtttttagagattttttttttttttgatttgaggattaataggagattaggattaggggttaattgtgtgttttttttgttattgtattgaggagaggttggtaggtggatgtggatagtaaagtggaaatttttagtaggtattatttaggtagaagtttaataagtgtagtgatttttttttttgtttttttggtgaggtattaggagggtttttttttttttttttatatttttttatttttgttttttttgtagtttagtttttttttaattttttttaaattttttttttttaatagggtgtatagattttagttagaaaaataggtagtttttaaatgggattgttttttattgttaatgaaatgaatatttagggattgggttttttttttgtttgttttgggtttgatgtggttgtattttgtgttattagaggagttttttttttatttaagtgtgtttttttgtttagttttttttgtagatttttgttgggttgagttttttttgtttttaagagttaggagtggtttttgttgggatggaatgatttgtttttggggttgttttatgagtggtttttgtgaatttggattagttttgatgtgtaaattttattgtttggtttttagtgaatagatatagatttttgttattttttatgattttatagtttatgggattgggtttggggtagtgttagaggtatgtatggaggtgtgattttaggtgagttttgtggaaaatttttggtttatttgtgagttatggatagaatatgtagatttaggttttggtgatataagttttgtattgttaaaattgtgtgattttgagggttgattggtttgagaattttggatggtgtttttggttatttttattttttattttaattttttgggttttggttagaatttatagtttgtgtttgaagagtgttttttgtttttggtattttatttttgtttagttttagggaaaaggggagagggtagttttttgtagttagaggaagagtatattttttttggttgttttattttttgaagtagggtggttagttgaaggaggatatatttttgaggggtttagaggttgtttaagtttttttttgttttttgaagattgtgtattgagttgggtgtagtttttgggaattgtttttatttagattgttggggggtgggggggtaggatgagggtagagttgagaggttgtttaaggtttgggagagagaaaagttttttttaggatttgattttggtttttagtaattgtgatagttaaaaatgggtgttttgttttgataatagatttttgtggattttttggtatttggtttattagtgtttgtgaattttgttttgggagatttattgaaatttggatgtttaagttgggaggtgtgtagtaattaggaggatgagagggttgggtttgggttaggaaagtggttttttaaaatagatgttagggggattgtagttttgagttatgagaaaaaagttaaaggtgagatgatatgtattgaattggggtaaatattggaagaggagataaaattgtgtgtttgagtattggggtgtggggagggggggataaaatttgtatttagtgtaaattaaaattttgggagtaggtgggggttgttgtgtgttttttatttttagtttttttattaaggattttgagtttttatgtatttttgttttttggtttttttttttttttttgtttggttggtgagaggtggttgttggtgttttagtagtagttagatgttaggtgaagtttggagtgtggagtgtggggaagggaggggaagggaggggaggggaaaggaggggtggggtggggagtgtgtgtgggtttggttagtgtggggtggtgggtgggttgagtttggggatggtgtgggaggggggagggaaggggggtagttgtgggtagggagttgggtttggttgttagtattaaagatggagaggtgttggggttttgtaggggagggggtttggtgttgatgtgggatgtggtggaggtgtagtagttggtggtgatttgttaattttgtagtagagaggagttgagggtgatgagagtgggtattgtgaattgttgggtgatgttgttgttgttgttgtgatatggagagtaatagttttttagtaatatttttttttgatataggtatatattttttgataggtatgtatatttattttatagtgtttggtttggttgtggtgagtgaggggttgggaagaggtgtattgtttagtgagtgttgtgtgttggggttttttggggttggagaggtttggggggtgtgtgtttgttttggttatttggttgttgggtttgtgttttttttatttggtgtgttttttttttgttgttgtagttgttgttgttattggttgggggttggttagaagggggagttttggttgttagtttgggtgtagttgtttttttagttttttttttttagggtatggttggggtgagaggtggggggtgtagtggtgtgtgggggttgagggtgtgagtagaggggttggggatttggaggttttgtattgttaggggttggtggagtaatagagtttgtgggtgtttttatgtatgtggattggtgtgtgggtgtaagataaggttgtggtttatttatttgtgtgtttatttgttggttggttgggaagttagaattggaggagttgatgagtagatttgggggtggaggggagtaggattgggattgtttatgttttgtttttttttgagaaaatgtggtgggtttttttttgattggatttgatttttattttttttttgtaggggagggagggaagttttagagggtttgtagtgttgtgggttttttttggtttttggtgggattggtggtgatattggagtttgttgtgtgtttttggttgtttttggtgggtgttggtttttgtatttgatgtgtttgggatgttttttttattttggtgtgtttgttgttagtttgtatagtgttttgtatatttttgtatgtgtttgaaatgtgtatggttttgttggtttgtggaattatttggatgtatggagtgttttgtattgatttgtttgttgtttttttgagatgtttgtattgtgtttgggttgggtgtgttggttgttggtgttgttggttagaggtttgggatttagttggttgtttttagggggttatggttttgggttggagagggagggtgggtagatttttttttgtttttttttttataatttgttgtggggtttttgtgttttttttttgttgtggggtgggtttgttttttttgttgtttttgttgtggagtttagtttgtttggattgttgttgtttttttttgttttttttgtttttttttgtttttagtttagtttttttttttttaggagtttagttttttgggaaaagttgtttttttaagtttgttgaagttgtttttaagttttggtgggggttgttgggaattgggggggtgtgagagtgtggttgatttttggagtttgggtgggttattgttggtttttttttgtgttgtttggttggatgttgtagttagtgttagttggattgtgggtgttgagtggtgggtgggggagatggttgtttgtgggtgtttagattttttttaggatttaaaaggtttgttttagggtgttaagtttttatttttttggttgtttttttttagtttttagaaattttgatgtttgtgggaaagtatgtggtggtttggtttggttgaatgtttattttaattttgatggtttttgtttttattttggggtgggtagtaaaaatgttttgattagttgttttgtgaattttttttgtgtgagtttggtggtttttgaattgatagagttttttttgggggtggaggtaagtaagtagtgtttgaagagtgagggagagattttgttgttttttgtttttagtgtatttattgtaatattggttgttgtaagatagatatggggagggttttgggtttgtgtggtttttttaatatttttgtaagtgaggtttggagtttaggagtttttttattgattttgaataggttttgggagaggtttttgttttttagttttgttttttttttgtattggttgtaatttatattataggtgttggtgttaatattatttttagtgtttttgagttatgtttagtattttttgttgtttttggttataggatttgtagattttttggagtttgtgggatatatgtggagtttatatatttagtttagtatgagtatttttggttgtaggggattatatttaattatggtttttttttatattttaatgatttatttttttttgttttttagatttttttgtttattgggtagttgtgggtaggagggtaggtatgatattttatgtaagtgtgtgtgtgtaaatatatatatatttttttttttttttttgagatggagttttgtttttgttgtttaggttggagtgtagtggtataattttggtttatggtaatttttgttttttggttttaagtgatttttttgttttagttttttgagtagttgggattataggtgggtgttattgtgtttggttaattttgtattttttgtagagatggggtttttttatgttggttaggttggttttgaatttttgattttaggtgatttgtttgtttgggttttttaaagtgttgggattagaggtgtgagttattgtgttttgttttatatattttttttgtttgtttttggttggtgtatatatatatagtttagattttatattatatatataataattttgaggtttttgtgggtagaaatgatttaagttagtgtgtgggttgtgtgtgtttttgttagtatttagggatggggataggttttgggtttgttagtgttttgtagttttgagaatagtagaaggttagaggttaaggttgatggtgagaggatagtttttgtggaggagagtttagtgtttatagatttttgtggttatggttataggtttttggtttttaatgagtttgattttgtttttggggtttttgtagtgaggtagagtttggaaaaattgtttaaagataaggtttgatatttagggggttggtgtgaagttgataaggaaggggttaaagttttgttaattttaagtaagtgtattttattataatgaatgttggttttgtttagggagtttttatttttagatatagagaaagttgaggatttataggattttattataatttttattttattttatttaatagatgttatagagtagtgaattaggtatttgttgtggtagaattttttttttatttttagtatttttggtttgaaaggtagatttgtagatttttaggaagttattttaattaaaatttttaagatttttttgttaagggtttggtaatagggaggagggggtatgttgtagtggttgaatttttatttttagggatattgatgaatttgttttttgtttttttattttttttgtttttttttttttttttttttttagttttttttattggtttaggaagtttatttagttttgttatgtagagtttagaaggaaagaaagttttatgtttgagttgaggggagtattatggatttgataaaaatgggtatgatttagttgtagaattttagttattttatggggttattgtgtaaggttaattagatgtggttggttgggattttgtgtgatgtggttattatggtggatagttaggagttttatgtttattggatggtgttggtttgtattagtaagatgtttgagatttttttttattgtaatagttaatattatattttggatttttttttgttaaagattttttagtagattttggagtatgtatatatagttatgttgtaagttaaggtggaggatttggatgatttgttgtatgtggttgagattttggagattgagtatttggaggaatagtgtttgaagatgttggagattatttaggttttagatgataatgatatggaggttattatggttgatggtggggttgaggaagaagaggattgtaaggtttggtattttaagaatatttttattttgaagtattttagtgaggagagtgggtatgttagtgtggttggatagagtttttttgggtttatggtggattagagttttttagtttttattttatttggttttttagttatgagttttattaaggttgtagtggatagtttgatgattataggatagttttttttgtagggaattttttagttatttgtagggtttgaggagttaattttggttgggggtgggtggtattttggggtggttgaggtgaagatggagatgatgtaggtggatgaggtgtttagttaggatagttttggggtagttgagtttagtattttaggagggatgggggataaggttgaggaaagaggtaaagaggggtttgggattttgatttgaagtagtgttattattagtgttagggagttatattatgggtgagaggagagtgttgagtaggtgttatttttagttgaggttggttaggtttttattggttgatttgagtatttagtatttttgtttgagaagtatttgggtatttattttgtgttgtttaattataaggttgatgttgtattgagtatgttgttttttgtgatttttggtttttatgtgtagtttgttttggttgtttttatggattttagtatttatggggggttgttgttttagggttttatttagagggagttgtttagtaagttgggggagttggttgtgggtatgaagttagagagttggattattggagagtagtgtagtgtgtgtggggttgagttttttgataatgaggttgtggagtagtataggtaggttttgttttagttttgtatttgatgtaggatttgaggtttttatattttttttttatattttggttgtttttaagttaggggtttggtttttttgttttggtaatttgtgaaaaaattagaatattttttttaaagttttggtggggaggggagtaggttttttaaagtgtagtgagggggtttaggatttttttaaaaagtattaggggatatttatgggtgtagttttttaataggtttttttttttgttttttgtttttgggtttttgtttgtttttttggttgtttggtttgtttttttttgtttggagtgattgataaaatggagagaaggagaaaaggagtgggatgagggttttttgggttttgtatttgattatgttattaggttttaggtttttgggtttttatgtagtggtttttgtgaagatagtttgtttttttttgtagtttgggagaatgggagggtttgggggttgtttaagttataagagtagttgtaggttttgaattttatttttggtgaaagttaatttttttgttttgtttttttttttattttttgattttgtatatgtatttagggggaattgatttaaatgtaaggggaaaggatgggtataagagttttggttttgtagtttgtgaagttttatttttattttatttttgtttatattgaattaaatgttgttttaggttagtattggtttttttttggtttttgtttttttttttatgaaataattatttattgagtttttatgatatgtttggtttagtattaagtattttttatgagttgtatttttattataatagttttttgagataggtaatgttttttttttttttttggatgtgaagttttgttttttttgtttaggttggagtgtaatggtgtgatttttgtttattgtaatttttgtattttgggttaaggtgatttttttgttttagttttttgagtagtttggattataggtatgtattattatatttggttaattttgaatttttagtagagatgggtttttattgtgttggttaggatggttttgaatttttgattttaggtgattggtttgttttggttttttaaagtgttggattataggtatgagttattgtgtttagttggtaatgttttttttttatatggaataatattaaggtttagatgttaagttttttttttagggttatatagatagtaagaggtagagttggatttaaatttaggtttttattttttggtattttgttgttttttggagttatttagatttgaagaggattatgtttatggaatagagtgttttgaagattgtttataggaagtggagtaaataataggggggataagtagtgagtttgttttttttttttttgtttttgttataaattatgtgtttattattttattttttagtttttgggttagatgaatggagttaagaaatttagttttttgttgttattgatgatagtatttggttgtatattttgtggtttgttgttttgttgattttgggtggattttttattttttttttttttatttttatttttttgttgtttgtttaggtatgggggatgtgagtgagaggggttggggtggggatatttggaagttgattttattatttttagttggaatttgttttgattttgtttttttgatagtttagaggtttaatttgtggaaagtgtggtagagttaaatgtagttgattttttttagtgggtgtgaaaaataattgttattaaggtgtgtttttttgatgtttgtattgtttagaaatagattgaggttgtgtttgtttttgtttaaatttttttaaagaggaaatttgttttttaaagttgattagatagatgtattatttttttggatgtgaattattttggttgtgtgttatgagaattgggtatggtgggaagtaattgtttttttggtttttattaggttttggtttttggttgtttttttttatttgagagggttataaaagatattatttttttgagatttttaagtttttttttagtaagatttttatttttttggggagagagggagagttggttatgttatatttgaaagagtttgggtattggaattggttatatttagtggtgagagtttgtgatatttatttaatttttttgggttttgttttatttattatatttttttttttttttttttttgagatggagttttgttttgttattgggttggagtgtaatggtgtgattttagtttattgtagtttttattttttgggtttaagtgatttttttgttttagttttttgagtagttgggattataggtatttgttattttgtttagttaattttttgtatttttagtagagatagggttttattatgttggttagaatggttttgattttttgattttgtgatttatttattttggttttttaaagtgttgggattatagttgtgagttattttgtttggtttttatttattttttaaaatggagatggttaatagggttggtgttgaattaatgaagtaagatttagaaattattagagttgtgatgggtatatagttattgtagtggtggagaattgattatttgttttttgtgttgtttaggttttatttttgtatggtttttattggttttgagttttagtgtgtagtgtttatagtgttattttttatgagggttgtgttgattgtgaggtggtgtagagaatgtttttgtttttgtgagtatatgatagtaagatattggttttggaattttttgtgttatatgtgggttgttgataggaagaatgtgtttttgttgttgttgttgttgttgaggtagagttttattttgttgtttaggttgtagtgtagtggtatgattttggtttattgtaatttttattttttgggtttaagtgatttttttgttttagttttttgagtagttgggattatagatgtgtattattatgtttgattaatttttgtatttttagtagagatggggttttattatgttggttaggttggtttggaatttttggttttaagtgatttatttgttttggttttttatagtgttgggattataggtgtgtgttattttgttgggttgagaatgtgtttttgattgagggtggaaagttagtagttgtagtttaagaagttagagttaggggtagtgtttttgatgggaagtttgggggtttaaagaaattagaaaggggagaaaataattttgtgtgtgtttagtttttatttagattaatagttttttgggttttagttagatgtattttgtagaaggtttttttttttttttttatttttaaaattttaggattaatgtgttatttttttttttttattgttttttgtttttttttaatttattagtagtttgagaaatgttatggtggaaaaaaaaaaataatagttttataattagtataaataaaaagttaagataaaaaaaaaaaaaaaattagaaggggagattttgaggttaggaagttatggtatttattggaaatatattagtgataaaataataggttatagggtttattttattttatttttaagttaataggtttgagtgttggtaaagattagatatttagtagttttttttgtatttttttttggggtgggggggtagaagggaatggagaggaaatgaaggtggattgttggtaagtgaggtaggaaggtagggagtttattatggaatgttattggtaagtttttttatgatttgattttaagttggtgtggagtgaagggtaagttgttggtttaatagatagtgagaattaaatttagtggagttgtagagtttgttttttgtagtggatagtaagatgtataagttgtttattgtaggaatgatgtgttgtaaaagggatgtagtgttaagtgtagttatggatgggtgggaagattagataaaggtatttaatgggattgatttatttaaataaattagaaggaagttagaatagtgggaagatttgatagataagtagtattttgtaggtagatgaaggagtaagttttgggtttttaaatttttattagtgtatttatattatagaggataatgtttgagggaggggaagattattttaggattttggaatattgggtttttttttttttattttaaaaggttggagtagttttgtatgtaggtttttttggaaatggtttaggaattagtttatttaggttaggagtatttgattatttttagagttatgtatatatgtgataagattgtagggaatagtatagttttatagatttaagtgtgaatatagtttttatttatagtttttagttttttatggtttatgtagtttggtttttatgtgtttttgaatttagtgttgtagaggtataatggggtttggtttttggattttatatagataagtatttaggttagttgtagtggatgttttgtatagatattgttgtaatttttgtttggtttttttttgtttttggagatggagttttgttttgttttttaggttggagtgtagtggtgtgattttagtttattgtaagttttgttttttaggtttatgttatttttttgttttagttttttaagtagttgggattataggtatttgttattatgtttggttaattttttgtatttttagtagagatagggttttattgtgttagttagtatggttttgattttttgaatttgtgatttatttgttttggttttttaaagtgttgggattataggtgtgagttattatgtttggtttattgtttggtttttgaagggatttttaggaattatagggaatgtttgagttagttttttggatttgtgtgtatagttttttttagaggttttgtggagttagttgtatggtgtatgagttttgtggttaagatattagagttttgtttggtttttggttttggttttttttagatggttagttgttttgtttttagtggttgattatgtagaaggttaataggtgttgattttggtttaggttatttttgggatttttgaggttttttgagatttttggtttttttttattattttgtttagaatttttgatgttaaattaaattttgtttggaaaagggtatgttgtagaataatgatagttatagtaatgatattaataatattttttattggttgtagtatttttttttttgtaaagtatttttaatgattttattttttttgtttttatagttttttttgagtgggtataggtttataattttatatttgtgataatgaagtttgaaaagttttgaaaattaaaaagtttgtagtaaatttatttagtggtaaaatttgatttgaattgatgtgaggttatatttattttgtttagtttgaatatttatatgttttgttgtaaaaatattaatgtgtttgattatagagtgttgttttagattttgttggggttgttaaatatgataggtgttagagtatttttttttttttttttttttttttttttttgagatggagttttgttttgttgtttaggttggattgtggattgtagtggtgtaattttggtttattgtaagttttgttttttgggtttatgttatttttttgttttagttttttgagtagttgggattataggtgtttgttattgtgtttggttaattttttgtatttttagtagagatggggttttattttgttagttaggatggttttgattttttgattttatgatttatttgttttggttttttaaagtgttgggattataggtgtgagttattgtgtttggtttagagtatttttttaaagtttgaatagttttggttgttgaagtatttgaaggttttggataagggattatgaatgattattattttttattgataaatgaggaaaatgagatttggagtaagtaagtgattttttatggttatatagttataaatgggtagaattaggtatttagtttgttttttaatttatagttttgggtgttttgtattaggttatataagaatatgagtattgtttttttgggttaaatttatttgatttagtttttggttgttattattatgtttaagatattattattggaggttataattattttttttgatgttaattttaaaggttaggtgtagttttttttagtagttatttatggttgttttgttatttatagatttgttaaaattttttttgaatttatttttatttttaggaagtattttttttaggggtgatgaatgataagtttataattttttgggtttttggaaatttggttttttggagagaggttgttggttgtgaagataggaagatggtagaaggttttgtagtggtgaggttaggtttagatttagttttgtgttttttagttttgttattattgatattgttttttttattgtgagttttaatttttttatttttaaaattaggtattttagtgagttttttttggattgttgtgttttttaaaaaatttttttattttttgtgtatttatttatatttttatgaagtttttttggttaattgaattttgttgttttggaatttggattggtagtttagttagttaagtagggggttagtttgatttgattttgtgtgttttgattttttttttttttttaaaatattttaatttgtttagggttattgagttatttgggatttagattgaatttttggaatttttgaagatgattttttttattttatttttaatggaggaaagttgtttatttttttattttagtgagaagttttattttaatttgttattattattggatggagttgttaattgttgggagggagaaagttatagtttagtaatatgttttttttttgtttgttttaggaaaattattatgaatttttaaaatagtgattattttaaattgttaaaattaaattttatttatagttttttgattttttgttaatttaggagagaaatttttttaattattttaattttttttattaatttaaagtaagttttgttgaaagtttaagtatatatgatttagagttttattaaatgaatataggtgtgttttagtttgtttattggagggtttttgaattttttataattaaagattttttattttgttttggttgggtgtgtggggtgaaagtttttattttttggtagttatttaagtagtaagaaatttgttataatttttttttatttttatgttttatagataggaaatgagtattttgattgtttaggttagatttttgattttgttatttattaattgtgatagtggttgtgttatttaatttttgtgtgtttgtttgtttatttgtgaaatagaaataatagtagtatttattttattgggttgttataaggatttattagaaaatatttattttgtgtgaggaatggtggtataaagtaagtgttttataagtgtttgttagggtattttttttgttattgtgtgaagtaggttatgttagttatgtagggtgaaaaatgtgtttatgttggtttagattttgttttttttttgagattgtttttttgtataggtgttaatttgtatagtgttgtaaaattgttgttttgggtattttatgtttggggttgagatattgtttttgtgttttttttagaagttgattttttgtattgtggtggttagggtattttttgttttattgatttgaggtttggtgagttattttagtttttgtttaaatttagttgggtagtgttttattgttattgggtttaaatgttggggaggtttattgatgtggtgttttgttgtttgtgtatgtggttaggtgtgtatattattgtgtttatgagagagatgaagagtatagatattattttattgatgggggttttggggttgggtttgtgggtgttgggggttttagagtttttttttttttttgtttgttagtgtaggatgtttttaaaatgtggatttagtagatattgttttgagtgtttgttatatgttagattttgtgttaagtgtatttatagttagtatttttgtaagatttttagttgttttgtaaggtgggtattagttttatatttttagatgggtggagagaagtttaagaggttagtggatttttttttagtaaagagttgtataggttgggtgtagtggtttatgtttgtaattttagtattttgggaggttgaggtgggtggattatgaggttaggagattgagattattttggttaatatagtgaaattttgtttttattaaaaatataaaaaattagttgggtgtggtggggggtgtttgtagttttagttatttgggaggttgaggtaggagaatggtgtgaatttgggaggtagagtttgtagtgagttgagattatgttatttattatattttagtttgggtaaaggagtgagattgttttaaaaaaaaaaaaaaaaaaaaaagagttgtattaggatttatgtttaggttttttggttttatgttttttgtagttgggtgattagggggtttatggttttattagttttggtttttttagtttttttggtggttttttgtgaggaggaaggttattgtagagggtttagttttttaggggtttaggttgtatggatttaaggattagtatgttattttttattaatatagagagattagtttttagtgatagaggttttttatgttgatttgaaaaatagaaaaagagagaaaaaagaaatttatttataaaaataaaaattttatgttgttaattttatgttagtataattagaaatttttttttttattgtttttttttaaaagttttggtgtttttattatgttggtgtagtttggaaaaattatggttgggttttgtttatgtgaggtttatttttgtagttgtaaggaggggatttggtattttattgttagtatggaaatttttgttaaatatttagaaaaattttaattttaaatttttagtttatttttaattgtgtttttgggatttgattttttttggtgtgaatagattgtgtttagtattgtagtagaaagggtttaagttaggtaagagaaaggattttttgagatattggggtgttattgagaaagttgttagaagattgttatagatattttgatgaaggggggatattttgggttatttgaagtggtttttagagtttttttttttttagggttatttggtttttttagaaataagaagaaaagatatatatatgtatataaattattattattaggtttgttgagaataagttaaatgtgttattaaattattgttttagtgggagatggggtggtattgtaggggtagaaagattgatgtttgatggatttgggtttgaatattagtgttttatggtgaatttgggtaaatgattttatttttgtgaagtagtagtatttttttttgtgaagtgaggttagtttttattttttaatgtggtttttaaagtatgttaatgagattatttgtaatttaaagtatatagagtgtgaggttatttttttattttttgttttttttatgattttagtttgataagggagttgttgagttttttgttatttttatttggtgttgtgttttaagtggattagtttagtgttgtgattttaatgttattaggtttgttggtatggttttttttgttatagtgagaagtagatgtggttgattataatggtttttagtgtgatttattgggtttatagtgttggggtaattattattagtgttaatttgggggagttttttatggtagttgggggaaatgtggagggattgttggaaatttatttaagttgtttagtaggttaggtgttgttggggtttattatggtaaaatttttagtttttttaatttatttttttaaggaatgtttttttttaatattgaagtttaggtttgattatttttagagttggagagataatttagtaggtttttgttttttgttgatgtattttattagtagtatttggtattataatttattaatgggaattagtgttttttttttgtgtggttagtgataagtagttttgttagttggagtttgttgtgtgaggaagtttttattagttttatggttaggagaatttgttttgtttaggaaatgaatgttgttgttaaaggtttgtggttttgattttggtggtataatttgtgtgggttggggagattttgtgtaggatgtttgggattttagtttttttttggtttttgttatatgtaaagagggaattattgtggtatgttgtagttttgaatttttgatttatgtagtgagggtgatttaattgtttttatgtttggatggttgtgtagtgatagagttgtgttgtgagtgtatgtgtttaggtatatgtgtgtgtggggtggttaaggggaaggagagatttttatgtgttagtaggggttgttgttgggagtgggtggattttatgggaggattttttttttttttttttttttttgtatttttgtagtatttaaattttttgtgattgttggttgtaaagtggtaagaagttggagagtattgtgtttggaattgaatttgggtttgaattaattttttgttttttagaggttgtgtgattgtggtaagattttttattatttatttttttatttgtgagatgaagttaataatttttgatttatattggtggtagagtagtgttgttaagtaggtgatgtatagagaatatatggtttagtgtttggttagtggtgtggttttaggttgtatatttgaaaggatgtgtatattttagtattttttttattgtaaaattaagggtttttttttttttttttttgagatagagttttattttgttgtttaggtttgagtgtagtggtgtgattttagtttattgtaatttttgttttttgggtttaagtgatttttgtgttttagttttttaagtatttgggattataggggtgtattattatatttggttaatttttgtatatatatatatatatatttagtagagatggggttttgttatgttggttaggttggttttgaatttttgattttaggtgatttgtttgttttagttttttaaagtgttgggattataggtgtgagttattgtgtttggtttaagtttttaaaaattaaaaagaatggtatagtgtttttttgttttttaatagattaagattaaaagttttttttttattatagtttaaagttttaaagaaaggttatttaagttgtttgtttttttttgttttttttatgagtaatgtttttaagtgtgatttttgtagagaatagtagtgtttgattttatttttgaggggaatttttttgtttgtttttttttgagaaaaaatgtttgtgagttgtttggtaaatggatgtgttatttttgttgttgttgttgttgttgttgttttaaaggtttttggtgataaaggagtgaattgtatttttggggaaagtatgttggaatttggtttagaaaagaggggttgttgggggaagggtttggagatgatgtttttttaggaattttaaaagaaatttgtttatttgtttttggtatttatggtattgttgatagtagtttaaggaaaaataaaaataagtttttatttgattgtggggttgattgtaaagttgaaggattagagtggttagtgagttgggtggttggatttggagttttggagaaagggttattggtttatttttgggtatgtatgtttatggaggtaagtttttatttttttgtgggtttttttttattttatgtggaaaaattgtgtatgttttaaattaaaagtagtttttgttttgtttagagttggtgaaagttgttttgaaggtgtttgtagagtagggattggaaatgtttaatgtaaaagttaaattgtgatagttgttttttaaatgatttgttaaattaaggatttgttaatatttgtgagtttatttttttgtattttttttatttttatttttgtttttttggtagaagggataaagatggtatttaaaaataatgtgaagtggttgttaaattgagtgattttaaaaatatttttttttttttgaagtttagtgtggaaaattagattggatttgttagggatgtagatttatatagggtttatgtgtttggtttttttttttattttttagtataatggtttttattgttattttttttgtgttttttttttttttataattatttattattttattttttgtgttttgatagttataagagtagtttttgtttttttgagttgagtagttgttaaatattttttagtagttagatttaatggttgggggggagaataggttaaattttggtattttttgttgtaaaagtgaaaaatatttttgtttgtagttaattttagtggtaagtagattatgttaattggatgtaattgtttttagatatggttgagggttttgtgtgttgagatgaagggtttggtaagtgtttattttttgtgtaaattagtttattttatttagttttttattttggttagttttggattttgttattttgtttttattttttttttttttagtttgtagtttggtgtgagaagttgtttgttatgtttttttaagtgtaatttttttgttatttggagttattttttttttggtttttgatgtgagtttgtttttaaataatgagaagggtttgaaaagatgttatttggattttaggttattttttgttttttttttagtaaaggtagatttgaagagtattttttggttatgggggttgtattttggaatttagaattttttgttttttatgtattttttttttttattgttttttgatttttgatttttatttgggagaatatttttttttttttttaattagtttgatttttttttagtttgaattaagtatgttttagtgggtttgaaattttagaaaaaatgaaatggttgttgtgtagaggagaaggttgtggttatagaaaggagttgttttattagatgtgaagttgttattttgttttgtaaagtaggttgtattttttgatatatttgtttttttttgtaagaaagggaggggaaattttatttaagagaattttttttaggtttttgtgggtttttagggttgtaattgaagaaaagtgttaagatttatgtttttttaaattttgtttttgttttgtggttagttttatatttttagtgttatttgtataagaggttgttgtttatttttttatattagttttattgataatttttgtggtttgtttaataatttatgaggagtagattatttgataaatgttagtttttttaatatgtaaagataaattgttggggttagggtgaggggtggtgtgttatgaaggaggggataggtggggagttaggatttttttttagtgggttggagaagtgtgaaagagtttgatgaaagaaaataggtagtttgttatatataatagttgtatttattatatggttgattagttttttgtttttatttatttttttttttttttatgtggatatgtagagtttttgagaatattttattaagtgggttgtttatgtttatattaatataagatgggaaagggtggaggttatttttgttttttaagtttttattttttttttttttggttgttttttatttttataagttgttggttggtaagtaattgatgtttagaaaaatgatgtttatttgaaattttaaatgagtggattttttttattttttttgattttgtaggtgttttttgaagagttaaggagaaaagaaaatttttgattttattatttagttaataagttgtttgagaaataaataaaagagtttagattggttgttaaagttaggaatttagttgatagttttgttttgatgtttttgtaatgtttgtggattgtagagggtgttatttagagtagggggtatttattgggatagatttattgggaagttgaaatagttagtttaaagtttaagagatgttaaagatagtgaaatatagtttaggaattgagggggagggggttttttatttaagaaggagattttttaggagggggtgggtgtggtattttttagggatagtatggaatgaagggaagaaggttggttttagaaggaggtattttgtgggaggttgagataggtgggttatttgaggttaggagtttgagattagtttggttaatatggtgaaatttagtttttattaaaaatataaaaattagttgggtggtaggtgtttgtaattttagttagttgggggaggttgaggtaggaaaattgtttgggattataggtgtttgtaattttagttagttgggagaggttgaggtaggaaaattgtttgaaggaggtggaggttgtagtgagtttagattttgttgttgtattttagtttaagattttgttttattaaaaaaaaaaaaagaagaagaagaagaaggaggtattttggatgaagatttaggttttagaatttattatttgtatgttttgggtaagtggtttagtttttttgagtttttgtttattttttttttgaaaatgattattttgtttatggtaatgaggataaaaaatgtgtaaagtgtatagtagagtgtaggtgtattgggtagatatgtatgattgtgttgtagttttgttatggtttggggagaaattatgaaaggaattagtgaaattttttgttttgggtattgttaaattgatgatagtattaattttgtgttagtagttagttggtgaaataataggtgaataatgttagtatattgtgaatataaaagtttttatttgtaaagtgttattgttgttttaaagaagttatatttttaataaatgattgtttaattttgtgatgttgttatagttttatagagtttgggaatgtttgggaattttttttgaagtgtgtgttgtatttttttgttttgttttttgggagggtagatgtgattattggaaatggttaaaataatgtagtagtaaatttgttgattatagtgagtgataagtattgttggttgttgtgtttgatttggaaggtagattttggaaggggtgtgtggggaaggtttgttggtttagtattggggtgagtgttggttttattttttaggtgggaagtggataaggttaaggggtttttgatttttagttattatggttggatttttagtgaggaaggagttgttgttatggattgtttgggattgggaagattttttttaattgttgtaatgtttttgtatttgtggtttggttttttgtgagtttgggttttggggtggtatttttgttgttaaaagaatagaaaagaaaataaaataaaataaaaaattaggattgttattgttagatgttggttgaggttagaaagaatggattgagttttgattttttatattttggggagtagggaggtttgggaggtatagtggtttgagtttgaattttgattttgtttttttggaaggttttggaaggttaaaggagtttgtgtgtttaaattttagtttggtatttggtatatatttagtatgtatttttttttttttttttgataatgttttttgttttgaatatttgaatagtggagagaggaatgtttgttttttttttttattgaattaatatttgtttatttattgagtttaagatttattttaggattgtttgttggatttggtttttttgtgatttaatagtgtaggggttttgtgttgagttgtatatgtttgtttttgttggtgttttttttttttttttttttttttttgtattatttatagtaaattatattagaatagagtgttaaagaggaaggatgagttatttttattgaaattattgatgatataaataaaagtaaaatgtttattatgtgttttgtgtagtatttaaggttaggttgtgttaatttgaatgtttttaaattggatttgtgaaagtatatatatgtgggaaaaaatttaggtttaattagagggaagttatttattgaaaatttattttagtatttgtttttttttttttatttattttagatttatatttatattatgtttgttgttttggttaatgagagggattggtttatttattagttaaggtttgtttatttttggaaggttgaggaatagtatagagaggttgtttaagtgtttttgtttttatttttttttttgttatttgttgaggaaggtattttttatttgttttgtaggtgtgggtttttaatgtgtttaagaattatagttagagttgaagggtttttggaattatttattgtagtatgtttatttgggaggagtaagtggaggtttagagaggttttgtgattttttttaggttatatagtaagttagaggtaaaattaggatttttatttttagtttattttaattttttttttataagtttgtttgtgattgtttaggtttgttttttgtttttattaaggggtaggtaagattagaatttgatttgagagtagttttagatttttgtttgtgagggatgttggggggtttttggtatggtgatttgttttttgggatatttattaatttttttgttgttgagtttgagtagattaatgtatattaattttttaggatttatagataatgttttatgttgggggttttgagatttaaagattgttaagatatgggatttttttttgaagagtttatattttgagttaaaatatgtatgttgatatttatgatagagaataggaaatggaaagattatgatatatatatttagagttgaaatgatttttgtttggagtgatttattttaaattttaaaattttgttgagtatttattgtttgttgggtatttgggtaggttttgggaatattgtgatgagtaagatagataagatgtttatttttttggggtttttttaatggggaagaaagatttttatttagttagtagttttgtttgtaattgtgtaagggtgattttgatatatgttgggagtttggatgaagtagtatatgagtaggatattaaaggataagtaggttttgaagatggggatagaaagaaggaaaattgtggttagggttaggggagaaaataaggagtaattttttttggtaggaatgagggtgatttatgttggaatggtaggttggggttagattgtggtgttataaatgtgtggagagagattagagaaggtagtatgaagaatggagagaaaatgagtttgaagttgagtagatttgggtttagatttttatgttgttatttgtaaattgtgtgatgttggttattaaggattgtgaattggttgggtgtagtggtttatatttgttattttagtgttttgggaggttaaggtaggaggattgtgtgaggttagaagtttgagattggtttgggtaatatagtgagatgatttttataaaaaaaaaaaaaaaattaaaaatgtagttgtgtatgtttataattttagttttttgggtggttgaagagggaggatggtttgaatttataagtttaaggttgtggtgagttatgattatgttattgtattttagtttgggtaataaagtgagattttatttttattttaatataataataataataatagtaatatatattatgaattgtagtttttttatttttatagtgtagttattgtgtgggatagtttgaggatttggggtagtgtatttaatatattttgtatagtgtttgtaatagtgtagttgtttaataaatataattgttgtttgttttaattgttgtttttttttggattttattttgggagagttggagttttggaaggtatttgaaaaggagagtgatgtgattggagtgttttatattgatgtgatatttattaggtatgtgtttgattgttttttgttttttttttgtttttatgagtttgtttgaaaaggagtttagtgtgtgattattagtttttaaggagattttttttttgtattttgtatttggtattttattaagatttgatgagaggatatgaaatggatttttgttattttttggtgggtggggaagttgggagaggggtttggggagagggggtttttagttgttaggattaaaggaagtgatattttgaagttggtttgttggattgttatttgtttttttaatttttttttaatagaaatttagtttttttttttgtttttttgatagtgaatagtgatgttattttttgtgggttagttttggttgtggttgtagtattatgtaatgtttgtaaattgatagtggtatggggagataagggttttaatgttgtgtaatgaggggtatgggttgtttgtttgagtggtttttggtttttgggtaattgttaattttaatggaggagtgggttggttttggaaatgttgttttagggttttttgttggttttatggatgtttttttgtggttggataaaggaagtttatgtaggttgtttatagtgtagtatggttttgggttatgggtgtttggttgttttgttttttttttttttttgttttttttaaaaaaagaagttgaaagggggatagttttgtttggtatttattatttttaatttaaaattaaataaaataaatagtttttaaatataaattaaattttaatttgtagtatagatattttttttttttgtttgaaatttattggttattggaggttagttttaagaaattggttttggagattttggtttgaaaaggagttatgtttatttgttttatgttttagttgttggttttagggggttgtggtagaatatatattgtattttagttgttttttttttttaagtttttttagttatttatagtttttttagatgagttgagttttagtattgtgtttttttttttttgtttttttagggtgatagaatttattattttgatatttggggttgttttgttttgttgtggtgggagatgggttggaagggattttggaggtttttttgtgttttgtattatttagtttttttttggatttttttatttttgtagttaggagagggaagtaattgttttttgagtaggatattttatttttaaagtatttttgatgttgtttttttgttttattgt

SEQ ID NO: 80 - DNA, 26652 bp, Artificial Sequence
  chemically treated genomic DNA (Homo sapiens)
gtggtggggtgggggggtggtattaagaatattttgaaaatgaaatgttttgtttaaagaatagttattttttttttttggttgtgggggtggagggatttaaggggaagttgggtggtatagaatatgggagagtttttgaagttttttttagtttattttttattatagtagaatagggtaattttagatgttagggtagtggattttattattttaagagggtagaggggagagggtatagtgttagggtttagtttatttgaaagggttgtgggtggttgaggaagtttggaggggaaaggtagttgaagtataatatatgttttattatggttttttggagttagtgattgggatgtgagataagtgggtatggtttttttttaagttagagtttttaaaattaattttttaaagttagtttttagtggttagtgggttttgggtagggaaggaggatgtttatattgtaggttgaagtttaatttatatttaggaattgtttgttttatttggttttgggttaaaggtggtaggtgttaagtaagattattttttttttaatttttttttttaaaaaagataaagaaaagagaaaaataaaataattaaatatttgtagtttaaggttatgttgtgttgtgggtggtttatatgagttttttttatttaattataaaaaggtatttgtggaattagtgaggggttttggaatggtgtttttaaggttggtttgtttttttgttgaggttagtagttatttaggggttaggagttatttgggtaaatagtttatgttttttgttatataatgttggggtttttatttttttatgttattgttggtttgtagatattgtgtagtgttatgattatagttgagattggtttgtgggagatagtgttgttgtttattattagggaggtaagaggggagattgggtttttattaaaagagagttagagagatgggtaatagtttggtagattagttttagagtgttattttttttgattttgatagttgaagattttttttttttaggttttttttttagtttttttgtttattgagaggtggtaagggtttattttatgtttttttattaaattttggtagagtgttaggtataagatataggggagaggtttttttaggagttgatgattatgtattaaatttttttttagataggtttgtgaaggtagggaaggagtagggggtagttagatatatgtttagtggatgttatattagtatggagtattttagttatgttatttttttttttaaatgttttttaaggttttaatttttttgggataaagtttaaaaagaaatagtagttaaaataaatagtagttatatttattgagtaattatattgttataggtattgtgtagagtgtgttaagtatattattttaaatttttaggttattttatataataattgtattgtaggaatgaagaagttatagtttatggtgtgtgttgttgttgttgttgttgttgtgttgaaatagagatagggttttattttgttgtttaggttggagtgtagtggtgtgattatagtttattatagttttgaatttataagtttaagttattttttttttttagttatttgagaagttgggattatgggtatgtatagttgtatttttaattttttttttttttttgtaaagattgttttgttatattgtttaagttagttttaaatttttggttttatgtaatttttttgttttggttttttaaagtattgggatgataggtgtgagttattgtatttagttagtttatagtttttgatggttaatattatatagtttgtaagtggtagtatgaaaatttgaatttgggtttgtttaattttaaatttattttttttttattttttatgttgttttttttaatttttttttatgtatttatagtattatagtttgattttagtttattattttagtatgaattatttttatttttgttaaagaaagttattttttgtttttttttttggttttgattataattttttttttttttgtttttgtttttaaaatttatttattttttaatattttatttatgtgttattttatttaggtttttaatatgtattaaaattatttttatatagttatggataggattgttagttaagtaaggattttttttttttattaggaaagttttaggagggtagatgttttgtttattttgtttattatagtatttttagggtttatttaggtgtttagtagatagtaagtgtttaataaggttttaaaatttaaaatgaattattttagatagaagttattttaattttgaatatatatattatagtttttttattttttattttttgttatagatattaatatatatattttaatttaaagtataagttttttaaggaaaagttttatgttttagtaatttttgggttttaaaatttttaatatagggtattgtttgtaaattttaaggagttgatgtatattagtttgtttaggtttagtagtagagaggttaatgagtgttttaggaggtaagttattatgttagaaattttttagtattttttatagataaagatttgaaattgtttttaagttagattttagttttgtttattttttggtagaagtagagaatagatttgggtagttataggtaggtttgtgaaggaagaattaaagtgggttgggagtgagggttttggttttgtttttagtttgttgtgtgatttagggaaaattatagaatttttttggatttttatttattttttttaaatgagtatgttgtaataaatgattttaagggttttttagttttgattgtgatttttggatatattgagagtttatgtttgtaaagtaggtggagagtgttttttttaataggtggtaagaggaggaatggagatagggatatttagataatttttttgtgttattttttaattttttgaaaataaataaattttagttagtgaataagttagttttttttgttagttagaataataagtatgatatgaatatggatttgaagtaaatagaagggagaaagtagatattgaaatggatttttaataaataatttttttttagttaaatttgaatttttttttatatatgtatgtttttatagatttagtttgggagtatttaaattagtataatttggttttaaatattgtataaaatatatagtaagtattttgtttttatttatgttattaatggttttaatgggaatgatttattttttttttttaatattttgttttaatatggtttattataaataatgtagagagagagagagagagagagggagtattagtgagagtgagtatgtgtagtttagtataaggtttttgtattgttaggttataaaagagttgagtttaatagataattttaaggtgaattttgggtttagtggatgggtgagtgttggtttaatggagaggaaaagtaaatatttttttttttattatttaagtgtttggggtaaggaatattgttaggaaaggggaaaaaaatatatgttgagtatatgttaggtattaggttaagatttgaatatataagtttttttaattttttagagttttttaaagaggtagagttagaatttaaatttaggttattgtgttttttaggtttttttattttttggggtgtagggggttaaaatttaatttattttttttagttttaattaatatttaatagtgatagttttggttttttgttttgttttgtttttttttttgtttttttaataatagaagtgttgttttggagtttaaatttataggaggttaaattataaatgtagaaatattatagtagttaaaaggagtttttttagttttaggtaatttatggtagtgattttttttttattgggagtttagttatagtagttggaaattaaaagttttttggttttgtttattttttatttaagaagtgaggttaatatttattttagtgttgagttaataagttttttttatatattttttttagaatttgttttttgagttagatatagtagttgatagtgtttattatttattatagttaatagatttgttattgtattattttgattatttttaatagttatatttatttttttaaaaggtaaagtaaaagaatgtggtatatattttagaaagaatttttaaatatttttaaattttgtggggttgtggtagtattataggattaagtaattatttattagaaatgtggtttttttagaatagtagtagtattttgtaaatggaaatttttatatttataatgtattaatattatttatttattattttattagttggttgttagtatagggttagtattattattaatttagtagtgtttaaaataaaagattttattggttttttttatagtttttttttgggttataatagggttatagtgtaattatatatgtttatttagtatatttgtattttgttatgtattttatatgttttttatttttattattatggataaggtggttatttttaaaagaaaagtaaataggggtttagagaagttaagttatttgtttaagatatatagatagtaaattttggagtttgagtttttatttagggtgtttttttttttttttttttttttttttttttttaatgagataaagttttgggttggagtgtaatggtaggatttgggtttattgtaatttttgttttttttaagtaatttttttgttttagttttttttgattagttgggattataggtatttgtaattttaagtgatttttttgttttagttttttttgattagttgggattataggtatttgttatttagttaatttttgtatttttagtagagattgggttttattatgttggttaggttggttttaaatttttgattttaggtgatttatttgttttagttttttatagggtgtttttttttaaagttaatttttttttttttattttatattgtttttagaaaatattatgtttgtttttttttagaaagttttttttttgagtgaggaatttttttttttttaatttttgggttgtattttattatttttagtattttttggattttgagttagttgttttaattttttagtgagtttgttttagtagatgttttttgttttaaatagtattttttgtgatttgtaaatattataaggatattaaaataaagttattagttgggtttttagttttagtagttagtttaaatttttttgtttgttttttagatagtttattgattaggtgatgaggttagaagtttttttttttttttggttttttaagaagtatttgtaaagttagggaaggtagaaaaagtttatttatttaagattttagatgaatattatttttttgagtattaattgtttattagttaataatttgtaggggtgggagatgattaagggagaaaaagatgggaatttaaaaagtaaagataatttttatttttttttattttgtattaatgtgggtataggtaatttatttgatgaaatgtttttagagattttgtatgtttatatgaaggaggagaaaagtaggtgagggtaggaagttgattaattgtatgataaatgtagttgttgtatgtgataagttatttgtttttttttattaggtttttttatatttttttagtttattaaaagagggttttggttttttatttgtttttttttttataatatattattttttattttgattttaatagtttatttttgtatattggaaaaattggtatttattaagtaatttattttttataggttgttaaatagattataggggttattagtggggttgatataggaagataaatagtaattttttatgtaaatagtattaagaatgtgggattggttataggataaaagtagaatttaggagaatatgaattttaatatttttttttagttgtaattttggaaatttataggaatttggagaaggtttttttgggtgggatttttttttttttttttgtagggaggggtaggtgtgttaggaggtgtagtttgttttgtaaggtaaggtggtggttttatgtttgatgaggtaatttttttttgtggttataatttttttttttgtgtaatagttgttttattttttttgagattttggatttattggaatgtgtttagtttaggttgaggaggagttggattaattgagagaaagagaaggtgtttttttaggtgagagttgggggttagagggtagtaggaaaaaaaaatgtatagaaaataaggagttttgggttttaagatgtaatttttatgattaggagatgttttttagatttgtttttgttgggaaagaggtgggaggtggtttggggtttaggtggtatttttttaaattttttttattatttaagggtaaatttatattaagaattaagaggagagtggttttaagtgataaaagaattatatttagaggaatatagtaagtggttttttatattaggttgtaggttggggagggggaaaatgggagtagaatgatagaatttagggttggttagaatgaaagattgaatggaataggttaatttatataggaagtaagtatttattagattttttattttaatatataaaatttttggttatatttggaagtaattatatttagttaatatgatttgtttgttattaaaattaattgtaaatagaaatattttttatttttgtaataggggatgttaaggtttggtttatttttttttttagttgttgaatttggttgttggggaatatttagtagttatttagtttaaaaaaataaaaattatttttgtagttgttaggatatagaaagtaaaatagtggataattatgaaggggggaaaggtgtgggagaggtggtaatgaaaattattgtgttagaaagtgaggaaaggggttaggtatatgggttttatataggtttgtatttttgataagtttagtttggttttttatattgaattttaaggaaagaaaaatgtttttagagttatttgatttagtagttgttttatattgtttttaggtattatttttattttttttgttaagggggtgggggtgggggtggggggaatgtagggaggtagatttataaatgttagtggatttttaatttagtagattatttaggggataattgttatgatttaatttttgtattgaatatttttaatttttattttataaatgtttttgaagtagtttttattggttttaagtggggtaagagttgtttttaatttgagatgtatatagtttttttatgtaaagtgaagagaagtttatgaggaggtgagaatttgtttttgtgagtgtgtgtgtttagaaatgagttagtggttttttttttaaaattttagatttagttgtttgatttgttggttattttagttttttggttttgtaattagttttgtaattagataagaatttatttttatttttttttgaattgttgttaatgatgttataaatgttagagatagatggatagattttttttaaagtttttgaggaggtgttatttttaaattttttttttagtggttttttttttttgggttagattttggtatgttttttttgaaagtgtagtttatttttttgttattaggggtttttaaaatggtagtggtagtaatagtagtaaaagtaatgtatttatttgttagataatttataaatatttttttttaagaagaggtaggtagaaaagttttttttaagaatgaggttagatattgttgttttttgtaaaaattatatttagaaatattatttatgggagaaataaaagaaaatgaataatttaagtagtttttttttaggattttgggttatgatggggggaaaatttttggttttgatttgttaaagagtaaaaaagtattatgttattttttttaatttttaaaaatttaggttaggtgtagtggtttatatttataattttagtattttaggaggttgagataggtagattatttgaggttgggagtttaagattagtttggttaatatggtgaaattttatttttattaaatatatatatatatatatataaaaattagttaggtgtggtggtgtatttttgtggttttaggtatttgggaggttgaggtatgagaattatttggatttaggaggtggaagttgtagtgagttgagattgtgttattgtatttaagtttgggtaataaagtaggattttgttttaagaaaaaaagaaaaaaaatttttaattttataatggaaaaaatattgaagtatatatatttttttaagtatataatttgaggttatattattggttggatgttgggttatgtattttttatatattatttatttaataatattgttttattattagtatgaattagaagttattaattttattttatagatgaggaagtgagtggtgaggaattttgttatggttatatagtttttaagagatagaagattaatttgaatttaggtttaattttagatataatgttttttagttttttattattttgtagttaataattgtaggaaatttagatgttgtaagaatgtaagaaaaagaaaaaagaaaaggaatttttttatgaaatttatttatttttagtaatagtttttgttagtatgtgggggtttttttttttttttgattattttatatatatatgtatttaggtatatatgtttataatatggttttgttattgtatagttgtttaggtatggaaatggttaagttgtttttattgtataaattaaaagtttaaggttgtaatatattataatgattttttttttatatatgataagaattagagaggggttgaaattttaagtattttgtatagggtttttttggtttgtataggttatgttgttagggttagggttgtggatttttagtggtaatatttattttttgaataggataagtttttttgattataaagttaataggaatttttttgtatggtgagttttggttgatagggttatttgttattggttatgtaggaggagagtattggtttttattagtgggttatgatgttaggtgttattaataaggtatattggtaagaaataagagtttgttaagttgtttttttaattttggaagtaattaggtttgggttttggtgttggggagggatgttttttaaagagatgggttgggggagttgagggttttgttatagtagattttagtagtatttaatttgttgaatagtttaaataaatttttaataatttttttatattttttttagttattataaaaagtttttttaaattaatattaataatggttgttttagtattgtgggtttgatggattatgttaagggttattatggttggttatatttgttttttattatggtaaggagagttgtgttaataggtttaatggtattaagattataatgttgagttaatttatttagagtataatgttgggtgagggtggtagggggtttagtggtttttttgttaggttggggttatgagagaagtaggaagtagggaggtggttttatattttgtgtgttttaggttataagtgattttattaatatattttaaaaattatattgagaggtaggggttaattttattttatagaagaggatattgttgttttatagaggtgaagttatttgtttaaatttattatggagtattagtatttaaatttaagtttattagatgttagtttttttgtttttgtagtgttattttattttttattaagatgatggtttggtggtatatttgatttgtttttagtaagtttggtggtggtggtttatgtgtgtgtatatgttttttttttttatttttgggggaattgaatggttttaaagaggaaagaattttaaaaattattttaaatggtttagaatgttttttttttattaaaatgtttgtgatagttttttaataatttttttagtaatattttagtgttttaggaagtttttttttttatttaatttggattttttttattgtaatgttgaatataatttgtttatattgaagaaaattaggttttgaggatatagttgaaagtgagttaggaatttagaattaaggtttttttaagtatttagtggaagtttttatgttgataataaagtattggattttttttttgtagttgtagagataagttttatgtaggtaaaatttaattatagtttttttagattgtattagtataataaggatattggggtttttaaggggaaatagtagaaaggggaatttttgattatgttggtatgaaattaatagtatgggatttttatttttgtaaatgggttttttttttttttttttttttgttttttaagttagtataaaaggtttttattattagaagttgatttttttgtgttggtaagagatgatgtattagtttttggatttatgtggtttgggtttttaaagagttgaattttttgtagtaatttttttttttgtaagaagttattagaggaattgaggaggttagagttggtgaagttatgagttttttggttatttagttgtagagagtatggagttagaagatttgaatataaattttggtataatttttttttttttttttttttttttgagatagttttatttttttgtttaggttggagtgtagtgagtggtatgattttggtttattgtaagttttgttttttgggtttatgttatttttttgttttagttttttgagtagttgggattataggtgttttttattatgtttggttaattttttgtatttttagtagagatggggttttattgtgttagttaggatggttttgattttttgattttgtgatttgtttgttttggttttttaaagtgttgggattataggtatgagttattgtgtttggtttgtataattttttattagagaaaagtttattaattttttgggtttttttttgtttatttgagaatgtgaaattgatatttattttataggatagttagaggttttatagagatgttggttgtgagtgtatttagtatagaatttgatatgtagtaagtatttaaaataatgtttgttgagtttatattttagaagtattttgtattgataggtaggaaagggaaggagttttggaatttttaatatttataagtttagttttaggatttttattagtaaggtggtatttgtgttttttattttttttataagtatagtgatgtgtatgtttggttatgtgtataggtaataggatattgtattagtgagtttttttggtatttggatttgatggtagtggagtgttgtttggttaaatttaaatgagaattggaatgatttattaggttttaggttaatgggataaagagtattttggttattatagtataagagattagtttttggggaagatgtagaagtaatgttttagttttaaatatgaggtgtttgaggtagtagttttatagtattgtatggattgatgtttatgtggaagaatggttttagggagaaagtaggatttggattaatatgaatatattttttattttgtatggttagtatgatttattttatataatgataagaaaaatattttagtaaatatttatggagtatttattttgtgttattgttttttatataggataaatattttttgatgaatttttataataatttaatgaagtaggtattattattatttttgttttataaatgagtaaataggtatatagaagttaagtaatataattattgttatagttagtaagtagtaaaattagaagtttgatttggatagttaaagtgtttattttttatttgtaaaatgtgggggtggggaagagttgtagtaaattttttattatttaaataattgttagagagtaagagtttttattttatatatttagttaaaatagaatagaaaatttttagttatggaaaatttagaaattttttaatggataaattgaggtatatttgtatttatttagtaagattttaagttatatatatttgggtttttagtagggtttgttttaaattaataaaaaaaattaaagtgattggaaaagttttttttttgaattagtaagaaattaaagagttgtgaatagaatttgattttaatagtttaggataattattattttaaagatttataatagtttttttagaatgagtaggaggaaaatgtgttgttaaattatagtttttttttttttagtaattagtggttttatttaatagtgatggtaaattaaaatgggattttttattgagatgaaagagtgggtaatttttttttattgaaaataaaataaaggaaattatttttaaaagttttaagagtttagtttagattttagatggtttagtaattttaagtaggttaaagtattttaaaaaaaaaaaaaaagttagaatatatagaattaaattaaattgattttttatttaattggttgaattgttaatttagattttaaaatagtaaaatttaattaattaaaaggattttatgaagatataagtgggtatataaagaataaaagaattttttaaagagtgtaataatttagaaagagtttattgaagtgtttagttttaaaaatgaagaagttaaggtttatgatgaaaaaaatgatgttaatggtgatagagttgaaaaatgtagagttaggtttagatttggttttattattataaagttttttgttatttttttatttttataattaataatttttttttaaaagattagatttttaggagtttaggagattataaatttgttatttattatttttaaaaaggatattttttggaaatggaaatggatttaaaaaggattttggtaaatttgtgaatgataaggtagttataaatagttattaagagaagttatatttgatttttaggattgatgttaaggaagatggttgtagtttttaatggtggtattttaggtatggtgatggtaattaaagattaggttagatggatttgatttagaagagtaatgtttatgtttttatatggtttggtgtagagtgtttaggattgtgaattagaaggtaagttgagtgtttggttttatttatttatagttgtgtgattatgggaagttatttatttgttttaaattttattttttttatttgttaatagagaatgataattgtttataattttttatttaaaatttttaggtgttttaatgattaaaattgtttagattttagaaaggtattttgggttgggtgtggtggtttatgtttgtaattttagtattttgggaggttgaggtgggtggattatgaggttaggagattgagattattttggttaataaggtgaaattttgtttttattaaaaatataaaaaattagttgggtgtggtggtgggtgtttgtagttttagttatttgggaggttgaggtaggagaatggtgtgaatttgggaagtggagtttgtagtgagttgagattgtgttattgtagtttgtagtttgatttgggtgatagagtgagattttgttttaaaaaaaaaaaaaaaaaaaaaaaaagaaaggtattttgatatttattgtgtttaatagttttagtagagtttagggtagtattttgtaattaaatatattaatatttttgtagtaaaatatatgaatatttaaattaagtaggataaatatagttttatattagtttagattaggttttgttattaaatgagtttattgtaaattttttagtttttagagttttttagattttattattatagatatgggattatggatttgtatttatttaaggaaggttgtgagggtaagagagataaagttattagaggtgttttgtaaagaagaaaatgttgtaattgataaaaggtattattaatattattgttgtggttattattattttatagtatatttttttttaaatagaatttagtttgatattagaggttttggatgggatgatgaaagaaaattaagagttttaggaaattttaaaaattttaaaagtagtttaaattaaggttaatatttgttggttttttatatgattaattattaaaaatagagtagttgattatttgagagagattaaggttaagggttaggtagaattttgatattttagttataaagtttatgtattgtatagttggttttataaagtttttgggaagggttgtatatatggatttagaaagttggtttagatattttttgtggtttttgagaatttttttaagaattaggtaataggttgggtgtggtggtttatatttgtaattttagtattttgggaggttgaggtaggtggattatgagtttaggagattgagattatattggttaatatggtgaaattttgtttttattaaaaatataaaaaattagttgggtgtggtggtgggtgtttgtagttttaattatttgggaggttgaggtaggagaatagtgtgaatttgggaggtagagtttgtagtgagttgagattgtgttattgtattttagtttgggagatagagtgagattttatttttaaaaataaaaaggaattaggtaagagttgtgatggtgtttgtgtaggatatttattgtagttgatttaagtgtttgtttgtataagatttagaaattagattttattgtgtttttgtagtattaaatttagaaatatataaagattaagttgtgtgagttatgggagattagggattataaatgaggattatgtttatatttaagtttatagaattatattgttttttgtaattttattgtatatgtatgtaattttgagaatgattaggtgtttttggtttggatgagttggtttttagattatttttagagaagtttatatgtagaattgttttagttttttggaataagaaagggagggtttagtgttttagaattttgagatgattttttttttttttaggtattattttttgtaatgtggatgtattggtgaagatttgggggtttaaagtttgtttttttatttgtttgtagaatattgtttatttattagatttttttattgttttgatttttttttggtttgtttaggtaagttagttttattggatgtttttgtttggtttttttatttatttatgattatatttgatattgtattttttttatagtatgttatttttgtagtggatggtttgtatattttgttgtttgttgtaggaaataggttttataattttattaagtttgatttttattatttgttgagttaatagtttattttttattttatattagtttgggattaaattatggggaaatttattgatgatattttataataaattttttgtttttttgttttatttattagtaatttgtttttattttttttttatttttttttgtttttttattttaagaagaaatgtaagaaggattgttgggtatttagtttttattaatatttaggtttattgatttaaaaataaaataaaataaattttgtagtttgttattttattattgatatatttttagtgaatgttatggttttttggttttaaaatttttttttttgattttttttttttttttgttttggttttttgtttgtattggttatagggttgttgtttttttttttttattatagtattttttagattgttgatgggttggggggagatagagaatagtagaaaaaagggaatagtatattaattttggagttttgagggtgagggggagaaaaaaagttttttataaagtatatttagttgggatttgaggggttgttgatttgagtgagggttgagtatatgtaggattatttttttttttttttgatttttttagatttttaagttttttattaaaggtattgtttttggttttaattttttgggttgtagttgttgattttttatttttagttaaaagtatatttttggtttagtagggtggtatatatttataattttagtattatgggaggttgagataggtggattatttaaggttaggagttttaggttagtttgattaatatggtgaaattttatttttattaaaaatataaaaattagttgggtatggtggtatatatttgtagttttagttgtttaggaggttgaggtaggagaattatttgaatttgggaagtagaggttgtagtgagttaagattatgttattgtattgtagtttgggtgatagagtaagattttgttttaataataataataataataaaagtatattttttttgttagtagtttatatgtgatatggaggattttagggttagtgttttgttgttatatgtttataaggatagggatattttttgtattattttatagttaatataatttttatggagggtggtattgtggatattatatattagaatttagagttaatgaggattatgtagagatgaggtttaaataatataagggatagatggttagttttttattgttgtggtgattatgtgtttattatagttttagtgatttttggattttattttattaatttagtattaattttgttgattgtttttattttaagaagtgagtgaaggttgggtggggtggtttatagttgtaattttagtattttgggaggttgaggtggatggattgtaaggttaagagattgagattattttggttaatatggtgaaattttgtttttattaaaaatataaaaaattagttgggtggggtgataggtgtttgtagttttagttatttaggaggttgaggtaggagaattgtttgaatttgggaggtggagattgtagtgagttgagattatgttattgtattttagtttggtgatagagtgagattttgttttaaaaaaaaaaaaaaaaaaaaatgtagtgagtgaaataaggtttagaaaggttaaataagtattataggtttttattattaaatatggttaattttaatatttaggtttttttgaatataatatggttaattttttttttttttttagaggaatgagggttttgttgaaggggaatttggaagttttaggagagtggtattttttgtggtttttttgggtaaagaaaagtaattaggaattaggatttgatgagagttagaaaaataattattttttattatatttagtttttatagtatatagttgaaataatttatatttggaaagatgatatatttatttggttaattttggggagtgggttttttttttaggaaagtttgagtaaaaataaatataattttagtttatttttgagtggtataagtattaagaagatatattttagtggtggttattttttgtatttattggaaaaagttggttatgtttagttttgttatattttttataagttaagtttttgagttgttgaggaggtagggttagagtagattttggttaggggtgatgagattaatttttagatatttttattttaattttttttatttatattttttgtatttgaatgagtaataggggaatgggggtgaagggggaggaagtggagaatttatttaagattagtaaaatagtagattatagggtatgtagttaaatgttgttgttaatgataatagaaagttggattttttgattttatttatttgatttagaaattagaggataaaatgatgggtatgtggtttatgatagaagtaaggaaaaaaaaaataaatttgttatttattttttttgttatttattttattttttataagtaatttttaaaatgttttgttttatagatatgattttttttaagtttaagtgattttaagaggtagtaaagtattagggggtaaggatttaaatttgaatttagttttgttttttattatttatgtgattttagaaaagagatttgatatttgagttttagtattgttttatgtaaaagaaggatattattagttggatatggtggtttatatttgtaatttagtattttgggaggttgaagtaggttgattatttgaggttgggagtttgagattattttgattaatatggtgaaagtttgtttttattaaaaatttaaaattagttaggtatggtggtgtgtgtttgtaatttgagttatttgggaggttgaggtaggagaattattttaatttgggatgtagaggttgtggtgagtagagattatattattgtattttagtttgggtaaggagagtgaaattttatatttaaaaaaaaaagaaggatattatttattttaaagggttgttgtaatgaaaatgtaatttatggaaagtgtttagtattgaattaaatatgttataagagtttaatgaatggttattttatagagaaggaaatggaagttggagggaagttaatgttagtttgaagtggtatttagtttagtgtgagtagagatgggataagaatgagattttataggttgtaagattaagatttttatatttattttttttttttgtatttaaattaattttttttaaatgtatgtgtaggattagagaatgagaagggagatagagtaaggagattaatttttattaggaataaggtttagaatttgtagttgtttttgtggtttaagtagtttttagatttttttatttttttaagttgtagaaagggataggttgtttttatagggattattgtatgggaatttgaggatttgaaatttagtaatatggttagatgtagggtttaagagatttttattttattttttttttttttttttttattttattagttattttaagtaaaggagaatagattaaatagttgaaaaaataaataggggtttaaaagtaaaaaataaagggaagggtttattaagaagttgtgtttatgagtgttttttggtgttttttggaaagattttaggtttttttattatattttaaaaaatttgtttttttttttgttagaattttagaagaagtgttttggtttttttataaattgttaagataggggagttaggtttttaatttgggagtagttagggtgtgaaggaggggtgtgagggttttaagttttatattaggtgtggggttggagtggggtttatttgtgttgttttatagttttgttattaggaagtttgattttatatatgttgtattgttttttgatggtttggttttttgattttatgtttatagttagtttttttagtttgttgaatagttttttttggatgaagttttggggtagtagttttttataggtgttgaagtttatggagatagttagggtaggttgtatgtggaggttagaggttatggaagatggtatgtttaatatagtgttagttttgtggttgggtaatatggagtagatgtttagatgttttttaggtgggggtgttgggtgtttaggttggttagtgggggtttggttagttttagttgggggtggtatttgtttggtattttttttttgtttatagtgtagttttttagtattggtgatgatgttgttttgagttggggttttaggtttttttttgtttttttttttaattttgttttttattttttttgagatgttggatttggttgttttagggttgttttggttgggtattttatttatttgtattatttttgtttttattttagttattttagggtgttgtttatttttagttagagttggttttttgggttttgtaggtggttgaagagttttttgtaggagagattgttttatggttattaaattgtttattgtagttttggtgggatttatggttgaaagattaaatgaagtggagattgaagggttttggtttattatgggtttagggaggttttgtttagttatattggtatatttattttttttgttggaatgttttgagatgaagatgtttttgaggtattgagttttgtggttttttttttttttggttttgttattggttatggtggtttttgtgttattgttgtttgaggtttggatggtttttagtatttttaggtattgtttttttaggtatttgatttttaggattttggttgtatatagtaggttatttaggttttttgttttggtttgtagtgtggttgtatatgtatattttagaatttgttggaaggtttttggtgagaggaagtttaaagtatagtgttgattattgtggtggaagaggattttaaatattttgttggtgtaggttagtattgtttggtgggtgtggaatttttggttgtttattatgatgattatattgtataaagttttggttagttgtatttggttggttttgtatagtagttttgtggggtggttagggttttgtagttggattatgtttatttttgttagatttatggtgttttttttggtttaggtatgaggttttttttttttttgggttttgtgtggtggggttgggtgggttttttgggttaatagaggaggttaggagaaagaagaggggaagaagtaaaagagatgagagaataaaagataaatttattagtgtttttaaaagtaagaatttaattattataatatgtttttttttttttgttgttaagtttttagtaagaggattttagagattttaattgaagtagttttttagaaatttataaatttgttttttaagttagggatgttgagagtaaaaagaaggttttgttatagtagatgtttaatttattattttatgatatttgttagatgaagtgaaatgaaaattgtagtgaagttttataagtttttagttttttttgtgtttgagagtaggggttttttaggtaaggttaatatttattatgatgaagtgtatttatttaaaattagtaagattttagttttttttttgttagttttatgttagttttttggatgttaagttttatttttaaatagtttttttaaattttgttttattataggagttttagaagtagagttaaatttattggaggttaggagtttgtagttatggttatagaaatttatggatattgggtttttttttgtaaaggttatttttttattattagttttggtttttggttttttattgtttttagggttgtaaagtattggtagatttaaggtttgtttttatttttaggtattaataggaatatatataatttatatattaatttgggttatttttatttatggaagttttaaagttattgtatgtataatataaaatttgaattgtgtgtatgtatattagttagagatagatagaaagagtgtgtggggtagggtgtggtggtttatgtttttaattttagtattttgggaggtttaggtaggtggattatttgaggttgggagtttgagattagtttgattaatatggagaagttttgtttttataaaaaatataaaattagttaggtgtggtggtatttgtttgtaattttagttatttgggaggttgaggtaggagaattatttgaaattgggaggtggaggttgttgtgagttgagattgtgttattgtattttagtttgggtaataggagtaaaattttgttttagaaaaaaaaaaaaaagtgtgtgtgtgtttatatatatatatttatgtaaggtgttgtatttatttttttgtttataattgtttggtggataggaggatttaaaaaatgaagaaggatgggttattaaggtatggagagagattatagttaaatatggttttttatagttaggagtgtttatgttgggttgggtgtgtgaattttatgtgtgttttataggttttaaggagtttgtaagttttgtgattaggggtagtaagggatgttggatatggtttagaggtgttggaagtgatattggtattagtatttgtggtgtgagttataattagtatgaagggaagatagggttgggaaataaaggttttttttagagtttgtttgggattaataagagggtttttagattttaaattttgtttataggagtgttagaaagattgtgtaggtttaggattttttttgtgtttgttttatagtgattaatattgtagtgaatgtattgagagtaaggaatagtaaggttttttttttattttttgaatattgtttgtttgtttttatttttagaaggagttttattagtttaggagttattaagtttatgtagaaaggatttataggatggttggttaagatatttttgttgtttgttttggggtggggatggaggttgttaaggttgggatgagtatttagttgagttgagttattgtgtgtttttttgtagatattggggtttttgagaattaggagggaatagttaaaagaatggaagtttggtgttttgaaataagttttttgggttttgagggaaatttgggtgtttatgggtagttgttttttttatttgttgtttggtgtttgtgatttggttggtgttggttgtagtgtttagttaggtggtgtggggaagagttggtgataatttgtttgagttttggggattgattgtgtttttatatttttttagtttttagtgatttttattgagatttggagatgattttagtaaatttggggaagtaattttttttgaggagttagatttttgaaagaaggagagttgagttagggatgagggaaagtgaaagagatggggaggaatggtgatagtttgggtgggttggattttgtggtgagagtggtaggggaggtggatttgttttgtggtgaaggggaagtataaaagttttgtagtgagttgtgggaggaaaggtgagaaggggtttgtttgttttttttttttgatttagggttgtgattttttgggagtgattggttgggttttaggtttttggttagtggtgttagtggttagtgtgtttggtttaagtatggtgtgagtgttttggggaggtggtgagtgagttggtgtggagtgttttgtgtgtttgggtggttttgtgggttggtgggattgtgtgtattttaagtgtgtgtgggagtgtgtgaggtgttgtgtgagttagtggtgggtgtgttagggtgggaaaggtattttgaatgtattaggtgtagagattggtatttattgagagtggttgggagtgtatggtgagttttggtgttattgttggttttgttgagagttgaggagggtttgtagtgttgtagattttttggagttttttttttttttttgtaaaaggggggtggggattaagtttaattaagaaaaagtttattatgtttttttaaagagaaataaaatgtaagtagttttagttttgtttttttttgtttttagatttatttgttagtttttttgattttagttttttagttggttggtgaataaatatataaataaataaattataattttattttgtgtttgtgtattggtttgtatatataagagtatttatgggttttgttgttttgttagtttttggtggtataaagtttttggatttttgatttttttgtttatgtttttagtttttgtatattgttatgttttttattttttattttgattgtgttttgaagaggaagggttggggaggtagttgtgtttaggttgatagttggggtttttttttttagttgatttttaattggtggtggtgatggttgtagtggtaggaagggaatatgttaaataaaaaaggtataagtttagtggttgagtggttgaagtgagtgtgtgttttttagatttttttagttttgggaagttttggtgtgtggtgtttgttgggtggtgtgtttttttttggttttttatttattgtagttgagttgggtattgtggggtgggtgtgtgtgtttgttggggggtgtgtgtttgtgttggggaggggtgttgttggggaattgttgttttttgtattatggtggtagtgatagtattgtttggtagtttgtagtatttgtttttattgtttttaatttttttttgttgtgaggttagtaaattattattggttgttgtgtttttgttgtgttttatgttaatgttgagtttttttttttgtaaggttttggtgtttttttatttttagtgttggtggttgagtttggttttttgtttatagttgttttttttttttttttttttttgtgttgtttttgggtttagtttgtttattattttgtattggttgagtttgtgtgtgttttttgttttatttttttttttttttttttttttttttttttttttttttgtgttttgtgttttgggttttgtttgatatttagttgttgttggggtgttggtggttgttttttattggttgagtggagaggaaggaaggagttagaggataggagtgtatggggatttagaatttttaataggggaattgagggtgaagggtgtgtagtagtttttatttatttttaagattttaatttgtattggatatgggttttgtttttttttttttgtattttggtgtttaagtatgtagttttgtttttttttttaatgtttgttttaatttagtgtgtgttattttgtttttaattttttttttatggtttggggttgtagtttttttgatatttgttttaaaaggttgtttttttagtttaaatttggtttttttatttttttggttattgtgtgttttttggtttgagtatttggattttaataagttttttgaggtagagtttgtgggtgttagtgaattaggtgttagaaggtttgtggggatttattgttgaagtgagatatttgtttttagttgttgtgattgttggaggttaaggttgagttttgggagaaattttttttttttttaaattttggatagttttttggttttgtttttattttatttttttgttttttagtaatttgggtggaaatagtttttgagaattgtgtttagtttagtgtatagtttttagggggtagggggaagtttggataatttttgggttttttaaaagtgtgtttttttttagttggttgttttattttagagggtagagtagttaaagaaaatgtattttttttttgattgtagaaagttgttttttttttttttttttggagttgagtgaaggtagggtgttagaggtgggaagtgttttttgggtatgggttgtggattttgattgaagtttaggaggttggggtgggaggtgggggtggttgagagtgttatttagggtttttaggttagttagtttttgaggttatgtggttttagtaatgtggagtttatgttattaaggtttgagtttgtatgttttgtttgtgatttatgggtgggttagaggttttttgtaggatttatttagaattatatttttatgtgtgtttttggtattgttttagatttagttttatgaattgtagggttatggaaggtggtagaaatttgtatttgtttgttgaaggttaggtggtagagtttatatattggaattgatttgggtttataagagttgtttatgaggtagttttaaagatgggttattttattttagtaagagttatttttgatttttaagagtagggaaagtttagtttagtaggagtttgtggagagagttgggtaggggaatatatttgagtgaaggaagggtttttttgatagtatgggatataattatattaaatttagggtaagtggaggggaagtttagtttttgggtatttattttattaataataaagagtaattttatttagagattatttgtttttttaattaaggtttatatattttgttagaggaaagggatttaaagaaagttaggaaagaattgggttgtaaggagagtaagagtggagggatgtaaggagaggagaaaagatttttttggtgttttattagggaaatagaagaaagaattattatatttgttgagtttttgtttagatagtgtttgttggaggtttttgttttgttgtttatatttatttattagtttttttttagtgtagtagtaggagaagtatataattaatttttgattttaattttttattaatttttaaattagagaaagagagaatttttggaaataatgggagagaaagtataattttttatggttttggtttttttatttttgtgttatatttattttatgtgaaaattttttttgttttataaatgttgtttattaaaagtttagtttttgttagtaagtgttaaagagagattaatgtttgaatttaagaggtggagaaggtaataaaaaggaagaaggtaggtgaggttgtgggttgaatgttagtattgggttttaagtatttttatttagtgttgaaggttggttgtatagtagtttgataaggtttattgggtttagataaagtagtagtagtttttttattaaaattggtattatttatagttagagttatgtttttgggttttgggaaggttgatgagaatttttagtttagagattttatatggtagtatttaaaaataagtaggatggaaaattataagagaatatttaattttttttgtgtgtatatgtttgt

SEQ ID NO: 81 - DNA, 2573 bp, Artificial Sequence
  chemically treated genomic DNA (Homo sapiens)
atgaaaggatagtagaaatagttttataattttattttttaggaataatttttatggatattttgttgtgtgtttattgtttttttaatatatatattttttaattaaatggaattgttttaaatatgttatttaatagtttgtttttttttatattatttgaaaattaagaaatgattataatatgttttatttaaaaattttaagtttaggttgggtatagtggtttatgtatgtaattttagtatttggagggattgaggtgggtggattataaggttaggagattgagattattttggttagtatggtgaaattttgtttttattaaaaatataaaatttagttgggtatgatggtatgtgtttgtagttttagttatttgggaggttgaggtaggagaattgtttgaatttgggaggtggaggttgtagtgagtggagattgtattattgtatttgtttggtgatagagtaagattttattttaaaaaataaataaagaaaatttgaagtatagtatttttttaaattttaaatagataatagaaattggtttttttttatttaaattagaatttaagtttaattttatatatttttgatagtttggattttgttttttaattttataaaattgggaatttaagtattatttggtttgatttaaatgtaatgtagaatttgtattaaaatattatattaaagttttagatttgtagtagttaatagtatttttatgtatgtgttagggattgttttaaatattttatatatattaatttttttattttgtatttttgtttttgttttatatagtaggaaattgaaatattgagaggttaagtaattaaagttatagagttagagtgataggagtaaagttttaatttaggtaatttagatttttagagttttgatttttattattaagttgttagtatagtttttttggtaattatttttaatttaaatataatttgagtgatttatttaataagttattattttgataatttagtgatttgtaatgtaaaattatttattgtaatttatttaatattattgtttttttgtgttgtaaaaattatagtaattgagatgtaatttattatttttttttttatttttggtattttgtgttaatttttttgttttgtggattttttttgattttttattatgtgtgttaattgttattaatttttttgtttgttggggattggggttgtgagggtatatttttgaggggtatggggttagggttaggtaggttgtgtggttgggtggggttttgtgttttattgtggagtgtgggttgggaagtggagagagaagtagttgtgtaatttgttggatgtggattagggtgttttttatttttgttgggagtttgttgattggttgggtgtgggtgtatgtgattgatatgtggttgtattggtgtagtttgttagggtgttattggagatagaatggaggtgttgttggatttggaaatggggtaggtgttggagttattatggttaggtttgttgtggggggaggggggaaggtggtttttttttgtattgttttaaattgatggtttttttttggtatagggtttattgtagtatgttaaatgaggaggtaggggtgttgtttttttgttttttattgtagtattggagatggattttttgtattttggatttagggtttttgatagaagaggaagaagggggaggggtagaagtgttaaggggagtttgttgagaaaagttgtttttgaagttagaaggggtttttgtttttataatgttatttgatagagtggaataatagtatttaaggaaatgggtagaggataataaagaatggagtatatttatggtgaggagtaaaagttttattttattgaaaggtttttttttttttttggtgataaggatatatgtattggtggttaaaagagagaggagataaaattgttgtagatggttgatgtgaatttagtggaaagagttattggggatgagagaaagaggaggaggtaggtattgtagagtgtgagtggtggtgttggttggtgaaatattggttattagtagtgtgtttgtttttgtaaaatatttaagtaaattttttgtgaatagggtggtaaatagatattagtgtttttgttagttataaaatgtagtggtagtggttttttgtggatgattgtagtagtgttttttttttttttgttaggttgaaaagataattgtagaggaataagaaattttgtagtaaatgttggggtagaagtttatttataagaagttatagtttataaatgtagtttgaatagtagaaaaaaaattattgttttttaaagtaggaataatgttaggttatgaatgttttgttattggaatgtattggatattttgattttatattatgaaagtgatgtttaaattttttgatttaatataaattttatatgaaattttaataaattatgtatgaaatagtggatttttttttttgttagtgaagtttttatgttattaattaggttatttaagagtaaattattttataatg

SEQ ID NO: 82 - DNA, 2573 bp, Artificial Sequence
  chemically treated genomic DNA (Homo sapiens)
tgttgtaaagtggtttgtttttgaatgatttaattaatggtataaaagttttattaataaaagaaaagatttattgttttatatataatttattaagattttgtataggatttatgttaaattaaagaatttgagtattatttttgtgatgtagaattaaagtgtttaatatattttaatgataaaatatttatagtttgatattatttttattttaaaaaatagtaattttttttttgttgtttaggttgtatttataaattatggttttttgtaaatgggtttttattttagtatttgttgtaaggttttttatttttttgtagttgtttttttggtttaatagagggagaaaaagtattgttgtagttgtttgtaaaaagttattattattgtattttgtaattaataaagatattggtatttgtttgttattttgtttatagggagtttatttagatgttttataaaagtaggtatattattggtgattagtattttattaattaatattattatttatgttttgtagtatttgttttttttttttttttttatttttagtagttttttttattagatttatattagttatttgtagtggttttgtttttttttttttttggttattaatgtatgtgtttttgttgttagggaggaaaagaagttttttaatggggtagagtttttgttttttgttatgaatatgttttattttttgttgttttttatttgtttttttagatattgttattttattttgttaaatggtattataaaaataaaaattttttttggttttaaaaatagttttttttagtagattttttttaatatttttatttttttttttttttttttttttgttaaaaattttggatttgaagtataggaaatttatttttagtgttgtagtggggggtggggggatgatgtttttgtttttttgtttggtatgttgtagtggattttgtgttaaggaaaggttattggtttaagatagtgtgagggaaaattatttttttttttttttttgtagtaagtttggttatggtggttttagtatttattttatttttgagtttggtagtatttttattttgtttttagtgatattttggtgggttgtattaatatagttatatgttggttatgtgtgtttatatttagttaattggtgggtttttgatgggaatggggagtgttttggtttgtatttagtggattatatagttgtttttttttttgttttttgatttgtattttgtagtggggtatagggttttgtttaattgtatagtttgtttagttttagttttgtattttttgggggtatgtttttgtggttttagtttttagtaagtaaggaagttgatggtagttgatatgtatagtaaagagttgggggaggtttgtagggtagaaggattagtataagatgttggaggtgggagggagagtaataaattatattttgattgttatgatttttgtagtatagagaaataataatattaaatgaattataatgaataattttatattataagttattgagttgttagagtgatgatttgttagatagattatttgaattatatttgaattaaaaatagttattagaaaagttatgttagtagtttagtagtggagattagaattttggaagtttgggttgtttgagttgaagttttatttttgttattttagttttgtaattttagttatttaattttttagtgttttaattttttgttgtataaaatgggaatagaagtatagaatagaggagttaatatatatgaagtatttagagtagtttttgatatatatatagaagtgttgttagttattataaatttgaggttttaatgtagtattttaatgtaaattttatattgtatttaaattgaattaggtgatgtttaaatttttaattttatgaggttgaaggataaaatttaaattgttaagaatatataaagttaaatttaaattttggtttaaatggggggaaattagtttttattatttatttaaaatttaaaaggatattatattttaagttttttttgtttgttttttgagatagagttttgttttgttattaggtgagtgtagtggtgtaatttttgtttattgtaatttttattttttgggtttaagtgatttttttgttttagttttttaagtagttgggattataggtatgtgttattatgtttagttaagttttgtatttttagtagagatggggttttattatgttggttaggatggttttaattttttgattttgtgatttgtttattttggtttttttaagtattgggattatatgtgtgagttattgtgtttggtttaaatttaaagtttttaaatgaagtatattataattgttttttaatttttaaatagtatgaaaagaagtaagttattaaatagtatatttgaggtaattttatttgattaaaaaatgtatatattagaaaagtaatagatatataataaaatgtttatagaggttatttttggaaagtgagattatggagttatttttgttgtttttttgt

SEQ ID NO: 83 - DNA, 4160 bp, Artificial Sequence
  chemically treated genomic DNA (Homo sapiens)
gtggttgaggggggaggattatgtgagtttaggagttttaggttatagtgaattatgattatgttgttgtattttagtttgggtgataaagtgagaatttgtttttaaaaaaagagagattgataaagttttttgtttatggagtttatattttagtggagtagaggggtttagattataaataaataattaaatgtatgatgtaattaatgaatgttgttttgggtatgtaataattattttttttgtgatttatttggatagaagaaaagattatttttagtttattttagtaatttatttaaaggaatattaatatattatggaatgttaattgtggattttgagatgttgtttttgagtttgggggttagaatatatgtgtttagatgtttttttgggtagatagattggagaaatgggttggtatgtataaatatgttagtagttagggagaatagtatgttttattagttgttggtagttagggtgttgaggattgaagtttgggtattagttgggttttattaaaggagagtgaaaaatttttgaagatttgaaaaggagagttttttgtagagaagtaaatatattatgatttaaaatttgatgttttaattttgtttttatttttatagtggtagataatataagttagggaatatttatttgtatattttagaaatttgatgtattaaggtttttatttgagattgttgtttattttatagattaatttatatgtttaaaaatttaattagattataaagagtataataatatgtttgttatggttttttttgttgatatattgtttagtatatgttaatgagagttttgattaattaatgtgaatttttttaagtaaaaggtttatttttttttttagaattaaagttggggttgggtgtagtggtttatgtttgtaattttagtattttgggaggttgaggtgggaggattatgaggttaggagattgagaatatttattaatatggtgatattttgtttgtattaaaaatataaaaagttagttgggtgtggtggtgggtgtttgtagttttagttgtttaggaggttgaggtaggagaatggtgtgaatttaggaggtggagtttgtagtgagttgagatggtgttattgtattttagtttgggtgatagagtgagattttgttttaaaaaaaaaagaataaaaaaattttaaaaaataaaaaaattaaaattgggtattatgaaggaaatttgagaaagaaaagtgattaattttagttgatgtaagtaattttatgtatttttttttttttgtatagtaagatattataatttatgattgttaaatttgagatagttgaagagtttagaaaaaaagattagggaagaaaatagaattgaaaaataatttagaatgatagaggttatttgtagtattaagggtaaaggtgggtaaaagaagaaaagggagatagaataaaagataaattaaaaaattgaaataaaatatatgggaatttaaatatttatattagaatataagggaatattttggaatttaaatatttttttaggtaagaatgtgtgttaatataaatgtttggtatattgttttttttttttttttttttttatttagtttatttagttttaaaagtgattttttaaaatgtatttttaaaagaatattttttgttaagtgatttaaatttgatatattttttggattattaaggaggttaaagttatatttggtgaaaaaggggtttattttttttttttttatatatgggttattgaatatttttaaaagtattttttattatgaatgaggggaaatggaagaaaagaggtggtgataattatttgtattttttaaatggatggaatgagtttttggagggtatatgaggttattagtgtgagtttgtggtggagttggaggtgtatttatagttggttgattttagttttgttgggtttttgttgttttttattttatgttgttggaatttgtgggtttgtaggttataggagtttgggtgtgttgggtttggtgtttttgaattgatgagggaagttgttttttttggtagatttttttggttggggagtttttattattttgtttgtgttttggtatgttggtaaggagtttgggaagagatgttgggagtggtgggtgggtgagaaataaatgtaatgtgatttatatttttttttgttgtaattattatgatttggttattttttattttggtgatttggtgtttttttagtgattttattttatgttagttgattggtgtttattgtagtgtgagtgttggttggaggaggggtttatgtgaaagagtttgtgagagtggggatatttggttttgaaggttggagtgggtgtttagggtgttgatggttgtagtgtttggtagttgtgtttatgtttttttttgttgtgttttattgtgtgttatttatggtgtttgtgggaagttatttgggtggtagttgtggggttggtttgtggggaggggttggtgggtttgtgtggaggagtagttttgatttttgtttgtattagtagtttggtgtttttttgttggtggttggtttttttttttggtaattgggtgttgggttttgtgaattttttgggtgtttttgttgtgtgtttggttttttttgtgtttggggtggggtggggtaggtgtttgtggttgggtgtgtgtggtgtgggtgggggtttttttagtgtgtgtgtgttgtgtaaggtttgtggatgtttgttttttttttaggtttttgtatttgtgttgttttttttttttttggtaagagttggtggtggtggtggtggttgttgtagagattggaatttgtttgttgggtttggtgaaggagaagggaggaggtaggagtgaggagggaggagggttaagggtgggtaggaaggtttaggtttggtgtgtttgtttgtgtgtggtgaagattgtatggtttgattgaggggtgattgggttggggttgttgtatgttaagggtgaaggttgatttgggttttattttgttttggtggtttgttgtgtttatttgttttgtgttgagggttggaggatgtgttttttggggtttgggtgagttgggagtgtgtgtgtggattggaggggttggttgtagtggggaggttagaggggtttgggtgaggttgtagaggtagttgggtgtgtggtggttggagttaggggttgtttggtttggttttggtagttttgtaggttttggtgtgtgttgggttgggattgtttagttagagatttatggtattttgtgttgtgttttttgttggttttttttttgttttttatttgtgggttgtaggttgagtttggggatgtggagtgggtgaaagttgttttggggatgtttttggaatttttaaatgggaaaggtgtttatttttttgttttggagtggtgaggttgatatttgtgatttggttttggatgttgtggggaggaataggggagaataaaatgagttttgggtgggggttgagtgagaggagtagttggtttgtttttgagtttttgtgggaaggggttttggtttttgagtttttggagttgttttatttgttgttttgtgtggtttttgttttgtggtttggtgattttgtattttagttttggaaaattttttgttggattgtttggatttttttttttttttttagatttttagtggaaagatttggtaaggaaaaaaaaatgagtttgtgttagggaagaaaaataatatgttgtgtgttagggtttggtgtttgagtgtggtatttttttatgtttttagatgttttaatttggttaaatttttgtaggtttttttttttaagtggttaataaattgtttagagtatatagtatgaatttggtatttgtgttatgttatttaatttttataatgattttggtttattgtattttttattgttttaggggaagaaattgagttgtaaagaggttaattaatttgtttaagggagttgggatttgaatttaggaatattgtattttggtaaatgaattaggaagaaaaaaaattaaaattgtttgtaaatatttttatgtttaggaatattttttagttatttttatttgaaattattg

SEQ ID NO: 84 - DNA, 4160 bp, Artificial Sequence
  chemically treated genomic DNA (Homo sapiens)
tgataattttaagtaagagtaattgaaaaatgtttttaaatgtaaaagtgtttgtaaatagttttggttttttttttttttaatttgtttgttagaatatgatgtttttgggtttaaattttagtttttttagataagttagttaatttttttgtgatttggtttttttttttaaaataatgaggaatataataaattagaattgttgtaaggattaaatgatgtaatataggtgttaagtttatattatgtattttgaatagtttgttaattgtttaaaagagaaaatttgtaggagtttgattaaattaaaatatttgagagtatgaaagagtattatgtttaaatgttagattttaatatatagtatattattttttttttttgatgtaagtttatttttttttttttgttaaatttttttattaggagtttggaaagagaaaaaagggtttaggtaatttagtagaaagttttttaaaattgaagtatggaattattaggttatggagtggaggttgtgtaggataataggtgaagtagttttgggagtttgggggttagggtttttttttgtggggatttgggggtgggttggttgttttttttatttgatttttgtttgaaatttattttgtttttttttgtttttttttatagtgtttggagttaaattataaatattagttttgttgttttggggtggggaggtgagtgttttttttatttaaggattttagaagtgtttttggagtgatttttgtttattttgtatttttaaatttggtttgtaatttgtgagtgggagataaaagaggggttggtgggggatgtggtgtggggtgttgtgggtttttggttgggtggttttggtttagtgtgtgttgaggtttgtggagttgttggggttgggttgggtagtttttggttttggttattgtgtgtttagttgtttttgtagttttgtttgagtttttttggtttttttgttgtggttagtttttttggtttgtatgtgtatttttaatttatttggattttagggaatgtattttttagtttttggtgtggagtgggtgggtgtggtgagttgttggggtgaagtggggtttgaattggtttttgtttttggtgtgtagtggttttgatttggttgttttttgattgggttgtgtgatttttgttgtgtgtggatggatgtgttgagtttaagtttttttgtttgtttttggtttttttttttttttgtttttgttttttttttttttttttgttaagtttggtaggtggattttaatttttgtagtggttgttgttattgttgttgatttttgttaggaggggagggggtggtgtgggtgtgggggtttgggggaggggtgggtgtttgtgggttttgtatggtgtgtgtgtattgggaaggtttttgtttgtgttgtgtgtatttgattatgggtgtttgttttgttttgttttggatatgaaaagagttgagtgtatggtggaagtgtttgaagagtttgtggagtttggtgtttagttgttggggaggagggttagttgttggtaagggggtgttgagttgttggtgtgggtgggagttggggttgtttttttgtgtgggtttgttggtttttttttataagttagttttatagttgttgtttgggtagttttttgtagatgttgtaggtagtatgtgatggaatgtggtggaggggagtgtggatatggttgttgggtgttgtggttattggtgttttggatgtttgttttggtttttggggttggatatttttatttttgtgggtttttttgtgtggattttttttttggttgatatttatattgtggtgaatgttagttagttggtgtgaaataaggttgttgggaaggtattaagttattaaggtgggggatggttaggttgtggtagttgtgataaagaaaaatataagttatattgtatttgttttttgtttatttattgtttttggtgtttttttttgggttttttgttagtgtgttgaggtgtaggtagggtgatggaggttttttggttgggaggatttgttggggagagtggttttttttattgatttgggagtgttaggtttggtgtgtttgggtttttgtgatttgtgagtttgtgaattttagtggtataagataaggagtggtgagggtttaataggattgaggttagttagttataaatatgtttttagttttattgtgggtttatgttggtgattttgtgtattttttggaggtttattttgtttatttggaaaatgtaaataattgttattatttttttttttttatttttttttatttatggtggaaaatgtttttaaaagtatttgatgatttgtatgtgaggaaagaggagataggttttttttttattaaatgtgattttaatttttttagtaatttaagaaatgtattaagtttaagttatttaataaaagatgtttttttaaaggtgtattttaaaaaattatttttaaaattgggtaaattgggtaaaaagaaagggggaaggaaaataatgtgttaggtatttgtattgatatatatttttgtttgaagaggtgtttagattttagggtatttttttatattttggtataaatgtttgaatttttgtgtattttgttttaattttttggtttattttttattttgttttttttttttttttttatttgtttttgtttttaatgttgtagatagtttttgttattttgaattattttttaattttgtttttttttttaatttttttttttgggttttttagttgttttaggtttgatagttatgggttgtagtattttgttatgtaggaagaagaggatatgtgagattatttgtattaattaaaattggttattttttttttttaagttttttttataatatttagttttagtttttttgttttttggggtttttttgtttttttttttttgagatggagttttgttttgttgtttaggttgaagtgtagtggtgttattttggtttattgtaagttttgttttttgggtttatgttatttttttgttttagttttttgagtagttgggattataggtgtttgttattatgtttggttaattttttgtatttttagtatagatggggtgttattgtgttaataggtgtttttgattttttgattttgtgatttttttgttttggttttttaaagtgttgggattataagtgtgagttattgtgtttagttttagttttagttttaaaggaaaagatgggttttttgtttaaggagatttatattgattggttaaagtttttattgatgtatgttgagtaatgtgttggtagagaaaattatggtaagtgtgttattatgttttttatagtttagttggatttttagatatatgaattggtttataaaatagataataattttaggtgggaattttagtatattaagtttttgaaatgtataaatgagtattttttggtttgtgttatttgttattgtagaaatgagagtaaaattgaagtattaaattttaagttgtgatatgtttgtttttttgtaaaagatttttttttttaaatttttaggaattttttgtttttttttgataaggtttagttagtatttaggttttaatttttagtgttttggttattagtagttagtggggtatgttgttttttttggttattggtatgtttatgtatgttagtttgtttttttggtttgtttgtttagggagatatttggatatgtgtgttttggtttttaaatttaaaagtaatattttgggatttatagttaatattttgtaatgtgttggtatttttttaagtgggttattagaataggttggaaatggtttttttttttgtttaggtaggttataagagaggtagttgttatatgtttaaagtagtatttattaattatattgtgtatttagttatttgtttgtggtttgagtttttttgttttattagaatataaattttatgagtaaaagattttgttagtttttttttttttagagataggtttttattttgttatttaggttggagtgtagtggtatagttatagtttattgtaatttggaatttttgggtttatgtgattttttttttttagttgt

SEQ ID NO: 85 - DNA, 7824 bp, Artificial Sequence
  chemically treated genomic DNA (Homo sapiens)
ttgtggttatagggttaattaaaatatatgtatttatatatattttgggtatttattttatttattgaattttattaatttatatatgtattataaaaagaatttgttttttaaatttatagagtttagttttattttggatataatgtgtttttaaaaatattgagagaatgaatggaaatattttattttatatgagtaaataaatgtattttatagatttaattttttaaatatttataaatttatgtttttttttataaaaatggatttaaattattgtttttattatttttaagattgagaaaggtatgttttaaaagagagtaatatttagttgataataagattgttaaatgtgaaattaaagataaattaaggagttaagttttaaagaattagtataagttgtttttttagtaaagaaattaaagaattaatttgaagtagaaagaaattttttgaatttgtaatgtttttttagttttaaatttttattttttggtttttggttttatgattgtttatatattttaaatattataaatgttaagtgtaaatataattttatataaagttttattgtatagaaaatagagtatggttaatttaagggggttatttattttatttgatttattatttattttgggggttggttttaatatgtgtagtgtatgtttgaatgttttgtgttaattttattgataatttttgttgggattagggaatattgtgaataagtaagtagaaaatgagggttgggtgtggtggtttatatttgtaattttagtattttgggatgttgaggtgagtggattatttgaggttaggagtttgagattagtttaattaatatggtgaaattttatttttattaaaaatataaaattagttaggtatggtggtgtatatttgtaattttagttatttaggaggttaaggtaggagaattgtttgaatttaggaggtagaagttgtagtgagttgagattatgttattttattttagtttgggtaataagagtgaattattgttttaaaaaaaaaaaaaaaaaaaaaaaaaaatgagatttgttattatttgtaagatttgtggttagtttggtattatattttttatatgttagaaaatatgttttaataaatatttgtgaatgaatagttattttatttgttatgttttttattttaatagagaattattagattaaattttttatttttttgatttataagattttgggtatatttaaaaaaaaataatatatttagaagttttaagtttgttgttgaaataagtattggaaaaaataagtgtgttattaagtattatttatttataaatgttaatatttttatttttaagtaattttgaatgtagttttttaattagaaatttaatataaatgaaaaatttttttttatagtttattttgaattgttgtatttatagaggtagttgtttagttttaattaatggtatgggaaaaataataggaaaaaaattgaaattgtatgttttttaatgtgatagttttaaattgatggagtaagttttttagagaaagtatttttaaagtgtattattggttgaggtaagaatgttgttattgttttttttttttttttttttttgtttgtagttaaattaagatttgagaaataaggttttattaaatagttgttttagaatttttagttttattaaagtttagatataaattatatttaaaagtttttataatgaaaagttttttataaatattgtgggggttgatttaattattagaataaagaagattatattagtgaagtaaagaattttttaaattttttataattaggagaaattagtaattggtaaatatatatatatagatatatttattataattaattattattattgttattattaataataaattgtaaattatgattatgattgtgaaaaaagtaaaattaatgttaaagtttttattggtttaaggtgtattgttgatagtatttagttagtaaagttttataattatgatatttatttagattgttatgttaaagaaaaggggtttttattttattttttgggagttttttttttttttgttattggttaatttttgtttagtatgttttttttattttgttttatttttttttattttgaggtgtttgaagagtatgattttagagggagttatttagtaagtgttttttagttttagttttttttattttgtagtttttatgatttaataagaagttgtgtatataatttttaatttatagtaaattgagtttttgtagaaggattttaattttttttttagaagttttaggataatttttgttgtttttttgtagttttttttaaagaatttatagtttggtttatatgggagtatattttgttttgatttttttgtattggtttttttaaagttagagaatagaattttttatagtgttaggtatttatttaatgtaaaaaatattgtagaattgattttttttttattttttgtttttttttaattgtttttttgggattatatttattatgttaatgagttgtattttagatatttgtgaaaagattgattaatttagttggttgtattttaaaagttttagagtttgttaattgagattagtttaaggtttttgaaaatatatttgttttaaagattaaagattaaaaattgttataatttgttttggtttaatagtggtttagagtgtaggttttggaataataatgttaattttgggagtttggagttgttattgatagaagatttagtgtaagttatttaatttttttattgtttgttattttttatatgtgttaagtgtttggaagagtatttgttttataataagtttttaattatttggagtaaatgtaagaaaatttaaaagttagattttttgttagtttttatggttatagaagggttttattatgaattaagttgataggagttaaaggaatttttttaagttatttgtatatgaaaaatgggatttttagtggtttttattttttttattttaaattttaaaatatagttgaaattgtttatgttaataaaattttatgaaatattttatatgttgaagagtgattaaaagaatttgtttttaagaaaaataaatttatttttttttttattttttttttttatttattttttttttttaattttaaatttaaaaaattataaagattgatgtattaattgtttagaaaaagtagaattttttatattttggggtgattaaattttatttttggttttggaggattggtagagagatttgatttaattattaagttggggttgtaaaaaagttagtttattagggtattttatttaagtatatttgggaagtaggggtttttaatttatattatagattgttagaagtaaggataagataaattagattatttgggggttgaaaaaaatgatggttgaatatttaatttgtgaaatttggtagtggatttgaataaatttatagttggggaagttagttaaattggtttgggaaagggaatagtagaaattttgtagtggtagttgatggttataagatgttattttatatgagtaaaaatgtttgttataaggtgtttggttgtaggtgattgaaggtgtagtgatggagaattgatgtgggtgatttgttttttttaatattatatattttttttgatggttgatgtagtgtttttttgggagtattttttgttagtttggttagatggttttttaaggtgttaggagggtttgaatttgagtgtggtttttttgtatttttgtgtttggggttaatgatggtttgggagtgtgggtattgtttttgaggttaggggtaggaggattggtggtttagaagtagaggggtttgtgggagagaagagaatagaaaattttgtagatgtgtggtggtttttttttttggtgtttgtttgttgtttttggttggaggttagtaaggttagtaggatttattttttgtttgtgttgtggttgtggagttttaagtgagttgtgttagttttgtggttggttagtgagggggtgagtggtggatgtagtgtggtttgagttttttgagttagttattttgggttgtgttttttatgtttatttttttttagatggggtgagtgggtgttgtttggtattgaagttgtagtgtgtttatttgtattggttgaatttggtgtatattgtttatttggtggggttgtttttgtaggtttttatgatggtttgtattttttttatattgattttattgttggtaaagagttggtgtaggatgtggattagattagttagggtttgtggttttagtattttggtttgttttattttgtggggagttggttgtgtgtgtgttttattgttgggttgtggtggaggagttgagtgagttaaggagttgggggtgagggagtttaatagtttgttagattgttaagtagatatatatgtataaatttagtattagagtgttgaaatgtaaggatgttgttgtagagatagtaagagatttatttttaggtttttggtagtgtagtggatttgggattgttggagatgtggtgtatatataaattaggtttagatttgtggggtttatttttttgggttttttttaagtgtttggagttattaggaatgtattaatggtttttggagggaggatgaggtggagagttatttaagaaaggtggtggaggtggggagattttgtgggtatggtttatgtgtatatttttggtttttttgggttttgtgtttttttaagagttttgttgtttttggtgttttagggattgtgtgggttttgtgtaattttttttttattttaatggtgtgttttagttgtttggtttaatgtttttttttgttttatttttgttgttgtggtttgtgatgttgggatgtagataaaaagggttggaggagatggttgtggggattgatgttgagtaaaggaggaaaagaaaagggaaggagagggatattttttttaaatagagaattgtgaggagtttgtgaaaattgaggatggattttatttttaggttagagagtgtttgttttgttgattgaaattatttatgatatgttttaggttaggtgaaaataagtttaagattttatatatatatatatttaagtatatatatatatatattttttaaaatgtgtattgaaatatattttgataaaggagatttgggtttttagtaagataattagtgaaatgatggaaaattaagaattttttgattttaaaattaaatatttttttttaaaaaatatttagtgtaaataatttgatattttatttgatggtgtaaaagggggttttttttgaggggatagggtgggttttgatgtaataatttaagaggttataattatatttgaattttttaattttaggtatgtgtttgaaggagtttgttagtatatatatataaggaaatatgtttttatgttatgtatagtatttagtatgttgggaataatataaattaagtatagtaggatttaaatgagaaagatgtgaaaggtggaagaaatgtaagtgtagatttttttttttttattatggatggatgtagggaataatttggatttaaggttattaaagttttagatttttgaagatttgtttttttttagattatgattatttttttttgtgtatatatatgtatataatgaaatttatttgtgttaggtagttttaaatatttttggtaaaatttgttatattatattttaatagtgttgttaaaagtggaattatttattgtttaaaaatggttataagtagaaagtattttagaagttagttttggtgatgtgtgttgttgtggggtagtgaattaataaagtattttgtgatagagtaatttgtaaattttttatggtttttttaaattattttttatttttggtaatgttttttattgagttttttaattattttattttagttagtttaatttataaatgtttggaatgaataataaaaatgaaatgtaagtataatttattttttttgtattttagttgataaaatttttaaatttttttgataatttattttttttttttgatttttttttttttttttatatttttatgaaagtaatatatttatgtagttaaaaaaaattaatagtattggaaggttaatgaaaagtagtaggtttttttaattatttttgattatttgttttgtgtttaaagagttagttttttaatttttttaattattttttgtggtagttattttttttttttaaaaataggtttatatttttttttgttttagtaattttagatattatttagttattttatattatgatagttttatttgtttattatttatttattaatttatttaataaatgtttttttgggtgaatagaaatttttattttatttgagtaaatatttaggagtgagattgttgggttatttagttagtgtatgtttaaatttgtaagaaattgatatattaatttgtaaagggtttgtgttattttatatttttaatagtgatgtatgagttttagttgttttgtatttttgttaggtattgttagttttattaattttggttaaatagaggtgtgttgatattgtattgtgttttttattttttatatttttaatttttatgggtaggtttttgtttttagagtttttaagatggtggttattgtttttaggatggtagtaagttttttgttttttgaattggggtttttggttttatggattttaaggaatggaattttggattatgtggtgagtgttatagttttattagaagttgtgggttatagaagagaattgtggaatttagttattagtgtttagtttaaataggatgaatttgggtatttagttatgtaggaataatggtaagtttttagttggattgggagtggtaatgggtgttttgttggattagtaaagtagtggatattttgttggatttggaggggtggaagttggtggtgggtttgtgatagtggtaaatagtagtggtgaaaagtgagtgaaagtttagtttgagttataataaatatagattagaagagtgtgtagttgttagatttaatagagtgaaaatatagtttttatataatgtgatggtatgtaaagagggttgttattttttgttttaatgtttgggtttatatttggattattgttttttttttatgtttttaggtgatatattatttgattatttttttattttttgttttagtttaatttgtattttagtgagttttttttattgtttgattggttgggtgtgagttgagttataagttttgtgtttaaaagtagttgtagttattttttttagttagggtttaggaatttttagttggtttaggaaatttagtttgttttgttttttataatgattaatgatgttgagtatatttttatgtgattagttatttgtaaataatttttggtgaaatatttaagtattttgtttttttaaaaatttaattatttgtttttattgttgagttttaagagtttattatatattttagaaataagttagatgtgtgatttgtatatatttttttttagtttgtgattggttttttgtttgtttttttggataaaggttttgttgtgttattgaggttggagtgtagtggagttattggtttattgtagtttttaatatttgagtttaggtaagtttattgtttatgtttattgagtggtagggattataggtgtg

SEQ ID NO: 86 - DNA, 7824 bp, Artificial Sequence
  chemically treated genomic DNA (Homo sapiens)
tatgtttgtagtttttgttatttagtaggtgtaggtagtaggtttgtttgagtttaggtgttgaaagttgtagtgagttaatggttttattgtattttagttttagtgatatagtaagatttttgtttaaaaaaataaataaaagattagttatagattgggaggaaatatatataaattatatatttgatttgtttttagaatatataataaatttttaaaatttaataataagaatagataattaagtttttaaaaggataaaatatttggatattttattaaaaattatttataaataattaattatataaaaatatgtttaatattattagttattatgagagataggataagttggattttttaggttgattaagaatttttaagttttagttgggaaaggtgattgtaattatttttaaatatggggtttgtaatttagtttatatttaattaattaggtagtaaagagggtttattaaaatataaattaggttaaagtaggaggtaaagaaatagttaaataatatattgtttgagagtatgggggagggataatgatttggatataaatttaggtattaaagtagggagtggtaattttttttgtgtgttgttgtattgtatgggagttgtgtttttattttattaaatttagtaattgtatatttttttggtttgtgtttgttatggtttgagttgagtttttgtttgttttttattattgttgtttgttattgttatagatttgttattgatttttatttttttagatttggtagggtgtttgttgttttgttgatttagtgaggtatttattgttatttttgatttggttaaaggtttgttattgtttttgtatggttaagtgtttgggtttgttttatttgagttgaatattagtagttgggttttatggtttttttttgtgatttatggtttttaatagagttataatatttattgtatggtttaaggttttattttttggaatttatgaggttaagaattttagtttagagaataaaaggtttgttgttattttgggagtggtggttattattttgggagttttaagaataaagatttgtttataagaattagagatatagaaaatgaagaatataatgtaatattagtatatttttatttggttaaaattggtaaaattgataatatttggtgaggatgtggggtaattagaatttatatattattgttgagaatgtgaaatggtatagattttttgtaaattagtatgttaattttttgtaaatttaaatatgtattgattaaatggtttagtaattttatttttaggtatttatttaggtgaaatgaaaatttttatttatttgaaaaaatatttgttgaataaattaatgaatgaataataaatgaatggagttattataatgtaaaatgattagataatatttaaaattgttgaaataaaaaaaaatataagtttatttttggaaaaaggaagtaattattataaggaatagttagaagagttaagagattgattttttaagtataggatagatggttaggaatggttaaaagggtttgttgttttttattgattttttagtattattgattttttttaattatgtgaatatattatttttataaaaatgtaaaaagaaaaagaggagttagagaaagaaaatgaattgttagaaaaatttagaagttttattaattgaaatgtagaaaagataaattgtgtttgtattttatttttgttgtttattttaaatatttatggattagattagttgaaatgaagtaattaagagatttaatagaaaatattgttaagaataaaaaataatttgaggaaattatgaaaagtttataggttattttgttataaaatattttgttaatttattattttgtagtaatatatattattaaggttggtttttggaatgttttttatttgtagttatttttgaataataggtgattttgtttttaataatattgttagaatataatgtagtgagttttattagagatgtttaagattatttggtataagtaaattttattgtatatatgtatatatatgagggagggtgattatagtttagaaaaaaataggtttttagaagtttagaattttaataattttaaatttaaattattttttgtgtttatttataatgagaaggaagaaatttatatttgtattttttttattttttatattttttttatttaaattttattgtatttgatttgtgttgtttttaatgtattaggtgttatgtatgatgtagaaatgtgtttttttatatgtatgtattagtaggtttttttaagtatatgtttaaggttgaaagatttaaatataattatagttttttaaattattgtgttagagtttgttttatttttttagaaaaagtttttttttatattattaaatgaaatattaggttatttgtattggatattttttaaaagaaaatatttgattttaaaattaaagagtttttggttttttattattttattaattgttttattagagatttgagttttttttgttaaaatatattttagtatgtattttaaaaaatatgtgtgtgtgtatatttaaatatatatatatataaagttttggatttatttttatttagtttggggtatattgtggatagttttaattgataaaataggtattttttggtttaggagtggaatttatttttaatttttgtaggttttttataattttttatttggaagaagtgtttttttttttttttttttttttttttttttatttagtgttagtttttgtagttattttttttgattttttttgtttatgttttagtgttgtgaattatagtggtggaggtggagtggggagaggtgttaggttgggtggttaaaatgtgttgttaaagtgggggagagattgtgtggagtttatgtgatttttgggatgttggagataatggggtttttgggaaggtgtggagtttggggaagttggggatgtgtgtgtgagttgtgtttgtagggtttttttgtttttgttattttttttgggtggttttttgttttgttttttttttgagggttgttggtatatttttagtgattttaagtgtttaaaaggggtttgggaggatgaattttatagatttgaatttgatttgtgtgtgtattgtgtttttagtgattttggatttattgtgttgttaggggtttgggggtgggttttttgttgtttttgtgatgatatttttatgttttggtattttaatgttgggtttgtgtgtgtgtgtttgtttagtggtttagtgggttgttaggtttttttgtttttagttttttggtttgtttagtttttttattgtagtttagtagtgagatgtgtgtgtagttagttttttatgagatggaatagattgaagtgttgaagttatggattttggttgatttgatttgtattttgtattagttttttgttggtgatgaggttaatgtagaggaggtgtaggttattatggaagtttatgagagtgattttattgagtgggtaatgtatgttaagtttgattagtataggtgagtgtgttgtagttttaatgttaggtggtgtttatttgttttgtttgaggaggaatggatgtgggggatgtagtttaaagtgattggtttgggaagtttgggttgtgttgtgtttgttgtttgtttttttgttggttagttgtggggttggtatgatttgtttggggttttgtggttatagtgtaggtggaaggtggattttattggttttgttgatttttggttgggaatggtggataggtgttgggaagggaggttattgtgtgtttgtgagattttttgttttttttttttttgtaaatttttttgtttttaaattattagtttttttgtttttggttttgggagtaatgtttatatttttaagttattgttaattttgggtgtggagatgtggagagattgtatttaggtttgggtttttttgatattttaaggaattgtttggttggattagtagagggtgtttttaggggagtattatattagttattgggagaagtgtgtgatgttgaagaagataagttatttgtgttagttttttattattgtgtttttggttgtttgtaattgggtattttatagtaagtatttttatttatgtaaaatagtgttttgtggttgttagttgttattatggaatttttgttgtttttttttttaaattaatttaattaatttttttgattgtgggtttatttaaatttattgttaagttttgtagattaaatatttgattgttgttttttttagtttttaaatgatttgatttattttatttttgtttttgatgatttgtaatgtaaattaaagatttttattttttagatgtatttgagtgaggtgttttggtaagttggtttttttgtagttttggtttggtgattaagttgaatttttttattaattttttggggttagaggtaaaatttaattattttgaagtgtgagaggttttattttttttgagtagttagtgtgttagtttttgtggttttttgggtttagggttaggagaaaggggtaagtgaaagaaaagaataaggaaagaagtaagtttgttttttttgggagtaggtttttttagttattttttaatatgtgggatgttttgtaaagttttgttggtatgggtggttttaattgtattttaggatttgaaatagaaaaagtgaagattattaaggattttattttttatatataagtgatttgaggaaatttttttggtttttattagtttagtttatggtagagtttttttgtagttgtgaaagttagtagagagtttagtttttaaatttttttgtatttgttttaggtaattgaagatttgttatgggataggtatttttttagatatttgatatatatgaggaatggtaggtaatgaagaagttgaatgatttgtattaggttttttattgatagtggttttaggtttttggggttagtattgttgttttagagtttatattttaaattattgttaaattaggataggttgtaatagtttttaatttttaatttttagaataagtgtatttttaaggattttgaattagttttgattgataaattttaaagtttttgaagtgtaattagttgggttgattggtttttttatagatatttgaggtatagtttattaatataatggatgtagttttgagggggtagttgggggaagataggagatgggagagaagttaattttatagtattttttgtattaaataggtgtttagtgttgtgaaggattttgttttttgattttgggagggttagtgtagaagaattaagatagaatatgtttttgtgtgggttaggttgtgaattttttgaaagaagttgtagagaagtaataaagattattttaagatttttggaggaagaattaggatttttttgtaggaatttagtttattgtgaattgaaggttgtgtatatagttttttgttaggttataaaggttataaagtagggaaaattgaggttaaaaagtatttattaagtaattttttttaggattatgttttttggatattttggggtggggaggaatgggataggatggaaggggtatgttggataagagttaattgatgatgaagggaaaaaaaatttttaaaaaatggagtaaagattttttttttttaatatgatagtttaaatgaatgttataattatgaaattttgttaattagatgttgttaatagtatattttggattaatagaaattttgatgttgattttgttttttttatagttgtggttgtggtttgtagtttgttgttggtggtggtagtggtggtggttggttgtggtgagtgtgtttgtgtgtatgtgtttgttagttattggttttttttaattgtaagaggtttagagggttttttattttattaatgtagttttttttgttttggtagttagattagtttttatggtatttgtggaagattttttattataagggtttttgaatgtggtttgtgtttaggttttagtaaaattaagaattttagaatagttatttaatgaaattttgttttttaagttttgatttagttataggtagaaaaaagaaaaaaaaaaaaataatagtaatatttttgttttaattagtaatgtattttggaaatattttttttgagaaatttattttattagtttgaggttgttatattgagaaatatgtaattttggttttttttttgttattttttttgtgttattaattaaaattgagtagttatttttgtaaatgtagtggtttaaaatgaattgtgaaaaaggattttttatttgtgttggatttttaattagaaaattgtatttaaagttgtttagaggtggaaatgttaatatttgtgaataaatggtatttggtgatatatttattttttttagtgtttgttttagtaatgaatttaaaatttttgaatatattgtttttttttaggtatatttgaaattttgtggattaaggaaatggaaaatttaatttgatgattttttgttggggtgaaggatatggtaggtaaaataattatttatttatagatatttattagagtatgttttttagtatatgaaaaatatagtattaggttagttataggttttataagtagtaataaattttatttttttttttttttttttttttttttgagatagtggtttatttttgttgtttaggttggagtgaaatggtatgattttagtttattgtaatttttgttttttgggtttaagtaatttttttgttttagttttttgagtagttgggattataggtatgtattattatgtttggttaattttgtatttttagtagagatggggttttattatgttggttaggttggttttgaatttttgattttaggtgatttatttattttggtattttaaagtgttgggattataggtatgagttattatatttagtttttattttttatttatttgtttataatgttttttaattttaataaaaattattaatggaattagtatagggtatttaggtatatattatatatattaaaattagtttttaaaatgaatagtaaattaaatgaggtaagtaatttttttaagttaattatattttgttttttgtgtagtaaaattttatgtgaaattgtgtttatatttgatatttgtggtgtttgaggtgtgtaaataattgtgggattaaagattaaaggatggagatttgaagttagaaaagtattgtaaatttagaaaatttttttttattttaagttaattttttagtttttttattgaaaaggtaatttatattgattttttgaaatttagttttttaatttatttttagttttatgtttgatagttttattattaattaagtattatttttttttgaaatatattttttttagttttgagaatggtaaaagtaataatttagatttatttttatgaaagaaaatatgaatttataagtgtttggaaagttaggtttgtagagtgtatttatttatttatatggaatgaagtgtttttatttatttttttaatatttttgaaagtatattatgtttagagtgggattagattttgtggatttaggaaataaattttttttatggtatatatataaattaataaaatttaatagatgaaatgaatatttaaaatgtatatagatatatatattttaattaattttgtaattatga

SEQ ID NO: 87 - DNA, 2665 bp, Artificial Sequence
  chemically treated genomic DNA (Homo sapiens)
ttttgaaaatgtttagatatatttaagaatttttattgagtaatataatgttttaattgaggtatatatgttgttttaggagtttgtgaaattttaaagataaaagtttgattatgtttgttttgattttaatgaattatttatataattttaatatatagtgtttaatatgtatgaaagttgtgtaatattttatattttaataatggagaattattaagtaattttggttattttgatattagtattttttgaaattttttaggttgatgtggtaaaggagaaatagtaattttgagttttgaaaagttaggttgtattttggttttgaaaaattatttgttgtgaatttgggttagtttttgattttttaaatggtataatagtttgttgttataagaggttatattaggaaaattttttaaggatttaagattttgtttatttattgagtttttttgggtgatttgtttaggaggaagtatttgtttttttttgagttgttttattaaagtatttgagtgagaaggtagaatataatgagaatgattatgttggtaaggaagatatatatatgagatgggttattttttatatttatgttagttaaaattgttttttatgaataaatttagtatttggtattttatttgatggttttaaaaatagagttttaaatttagaaggtaaggtgttatttttagtttttttttttggaggaaaatagtatgtattgtgttaggttaaggtttatggggatttgatttagtatttgggtaattggttgttaatggaattgaagatagttgggtttaataagtgtttaggtgatttaggtaagtgaggaaattagattgaggtttttttgtgtgggataggttaaattttgattaaattatagttgagttgggatgtttttttgtttaaagtttaaagtttggatgtggttggtagggtgtattggtgtgtgttttgtaggttatttttttgattggaatgatggtggtggttggttttttggggttgttggggttttttggggtatgttgttgttaggatttttgtagggtgtagatagtaggttttagtgaggttgtggaaggaaagttttgggtgttggggttgggtttggtgttggtttttgggttgggggggtgggggttgtgttgagatgtttttaggagaagttttgttgttgttgttattgtggttgtttgaggtgggtgtttttgggatatagttttggtttttggggttgtgtggtttatatgatagtgtggagtatgaggttgaattttattttttagttttaagtttttttattattagggttgggtggttttgttaggtagagtgttggtttttttaagagtaaatgatttggatatgtttgtgaagtttgtgtgaagaaggggaagtttgtggttgtttgtgtttttttgtttttttgtggttgtttggttgaaattaaattgaggggtggggtggtgaggatagggtatgttgtaggtttgtgtgggttgggtttggatttgtgttgttttgggatgtaaagtataataagagggttgggatgggtagtgtaggtttgtgaggtttgtgggtgtttttgttttttagttttttttgtagttggttttgtagtggtttattttggttgttgggtgtggatttgggttttggattgaaggttgtgtgttttttgttgtttattgtggttttgataggttggggttattgtggtgattatgagagtagttttggtgttatggaggagtttggggttattttttaattgtatttggggttgtttttggaggagttatgtagggtgagtttaggtgtgatgagtgttatgtggtttaggggttgtgggagttgttgggggaaggaagtagtagattggttttggggtttaagttgttgtggttagaggttttgaagttagtttttgtttgttgtttggtttttgtttgtgtttgaggtagtagttaggtttgtagggtgtttgagtggtttttgtgtgatggaggaggatttggggttttgggaaggtgaagaaagtatttgtttagttggattttgtaaagatgtaaatgttttttgatttttaaaattaattagtttttttgttatgttgtttattttgagtagagatatgtggtttttttgattgtgagaaatttgaggattgtttttttaaattagttatatttattgatgtaattttttgttgaattttgaaagaatatttgaggttgggtggggagttgaaattttgattttgtattttttttttttttggtaaagaatgaatgtttttttgagatgttttattatgagtgagattgttttttgtttttgttttgttaatgtatagtttagagatagtaaatttttagtgtttaaattttgttttttattttttaggtttagtttataattaagttgtagagatttttttttttaagtgtttttaggtatttttgttgatatgtgtaggggtatttatgttgttgtgtttttaaaaattggattaaatttttaaaaagattatttaattattgaggtagttatgattatgtttttttgttaggtgaattaaaggtagtgttgttatggtgtttatgagtttatagtttgtttaatgtatatgtatatatat

SEQ ID NO: 88 - DNA, 2665 bp, Artificial Sequence
  chemically treated genomic DNA (Homo sapiens)
atatatatgtgtatgtattagataaattatgaatttataaatattatggtaatattatttttaatttatttaataagaaaatataattgtaattgttttaataattaagtggtttttttaaagatttaatttagtttttaaaaatatggtgatataaatgtttttatatatgttaataaagatatttagaaatatttaaggagaaaaatttttataatttgattataaattagatttgaaaaataaaaaataaaatttgaatattgggagtttattatttttagattgtatattaataagatagaagtgaagaataattttatttatggtagagtattttaaaagggtatttattttttattaaaaaaaaaaaaaatgtagaattaaaattttaattttttgtttaattttaggtgtttttttaaggtttaatgagaagttatattagtaaatgtaattaatttaaaggaatagtttttaagttttttatagttgaaggaattatgtgtttttgtttaaaataaataatatagtggaaaggttaattagttttaggaattgggaaatatttatatttttgtaaagtttagttaagtaagtgttttttttatttttttagagttttaggtttttttttattatataaaaattatttaagtgttttatgagtttaattattgttttgaatatgggtgggagttgggtagtagatgaggattggttttgggatttttgattatggtggtttagattttaaagttggtttattgttttttttttttggtggtttttgtgatttttgggttatgtaatatttattgtgtttgggtttattttgtgtagtttttttaggagtagttttaaatatggttgaggggtaattttgggtttttttatagtgttaaagttgtttttgtggttgttatagtaattttggtttgttggggttataataaatggtggagaatatatagtttttggtttggaatttgaatttgtatttggtaattggagtggattattgtggagttggttgtggggggagttgggggataggggtatttgtaggttttataggtttatgttgtttattttgatttttttgttatattttatattttgaggtagtgtaggtttgagtttgatttgtataagtttgtgatgtattttgtttttgttattttattttttggtttggttttggttgggtagttgtgagaaggtggggaggtgtggatagttgtaaatttttttttttttgtgtaagttttgtagatgtgtttgggttgtttgtttttaaaggggttggtgttttatttggtgaagttatttagttttggtagtggagaggtttgggattagaggatgagatttggttttatattttgtgttgttgtgtgagttgtataattttaaagattagggttatgttttaagggtatttgttttgggtggttgtggtggtggtggtggtgagattttttttagaggtgttttggtgtaatttttatttttttgatttaggggttgatgttaggtttagttttgatatttaaggttttttttttgtagttttgttggagtttgttgtttgtgttttgtagaagttttgatggtggtgtattttgggagattttggtagttttgagaagttagttgttgttgttattttagttagaaaaatggtttgtggggtatgtgttggtgtgttttgttaattatgtttggattttggattttagataggaaggtgttttggtttagttgtggtttggttagagtttaatttgttttatgtaagagaattttgatttggtttttttgtttatttgagttatttgggtatttgttaggtttagttgtttttagttttattagtggttagttatttaaatgttaaattaaatttttgtggattttggtttggtgtggtgtgtgttgtttttttttgagaagaggagttaaaagtagtattttgttttttaaatttaggattttatttttaggattgttgaataaagtgttaagtgttggatttgtttgtaggagatggttttagttgatgtaggtgtaaaggataatttattttatatatatgttttttttgttagtatgattatttttattatattttgtttttttatttaagtattttggtgaagtaatttaaaaaggagtagatatttttttttaaataaattatttaaaagaatttaatagatgaataaaattttaaatttttaggaaatttttttgatgtaattttttgtagtaatgaattgttatgttatttaaaaaattaaaaattggtttaagtttatagtaagtgattttttaggattaaaatgtggtttagttttttagaatttaagattgttattttttttttgttatattagtttgaggagttttaggaaatgttaatattagagtagttaaaattgtttagtaattttttattgttaaggtataaggtattatataatttttatatgtgttagatattgtgtattaaaattatgtgaatagtttattaaagttaaaataagtataattaaatttttatttttagaattttatagatttttagaataatgtgtatgttttaattagaatattgtattatttaataaaaatttttaaatgtgtttgaatatttttggaa

SEQ ID NO: 89 - DNA, 8788 bp, Artificial Sequence
  chemically treated genomic DNA (Homo sapiens)
gttggggtttgtagtttgggtaattgaggagttaaatgtttttgagtgttgtgtttttaggtttttttggattttttttgggtttttttaagttgaggtagggggtgggttgggggtggagtaggagaataggaggttggtagtgaggtataagtttttttttggtaatagtgagtttgaagatatgtagttaagggtaagtgttgtagttgtttttgttgggatgggtggggttgtgattttttagtgtttagaggagagaagtttttttggttttttaattaagtagtggtgatgaggttagaaattagagtttatttagagtttaatatataggtttttttttttttttttttttattttttgggattatttattttttttaaaagtaatttttgtttttatttttaggatttaaggtttgtttgttaagtagtgaattttaataggtttttttaaagtgatagagtttttaggtgtgtttattaaaagaatatggttttgtgtgtattttatgtgtttttttttttagttttttgttagtaagattaatttttttaattgttttggatgtaaatttgtgtattggtaagagttttgattggttttgatggtattttggatttgggattgggtgagtttggttttaggagtttttagaaagttttttagtttaatgtagagataggagtttagttggtttttttaagtaggtttgggaagggggtttattttgagtttaagtttgggaaatttaagggtttagttgtttgatggaagttagttaatgggggaggggtaggatttttggttaagttttttttgtagtgtagtttgaggattaagtgtggggatagggggtatataggtattgtgaggtgaggggaaaataaaataaaataaaatattttggtgatgtgtgtaaggagtagatttgtttggagtttaggtttttgttttggttatttggttgttaatggggtaattttgagggttatgttattttttttaggttaggaggagtttgggatgaattttatgtttttgtgttttttttaggttagttgtatttataatttaaagattgaggttttttattttaattttttttttagttttttggggagggggtagtattattttttagagtggtgtattgtgatatttttgtgtttattttattaattagttaataattgtttaaattagagattttataggaatagaagaatatttagtaataaaaattagaaatatgttttatgatttgtgggggggggggggggttagtgtgtagatatagttttagggattttttattaatgatgaatatttttaattgtttttagtttgtgtttttaatatttaggtagtttgttatgattttaggttgtttagtttttttagtttgatttagttgtgttggttttgtttatattagtgtatagtttaagttagttaggatgttggggttatgtttgtattaatttagttaagggtttgaggtgtgttgggtttgtatagtttgtggttgtaagagtatttagagtgttttttaattttttgtaggaaattttatagttaaggaagtttagtggtttgagttatagggttttgttttgtgtgtttagaggtaatagtttattttggtttgtattggtgttttgtgatagtgtagtgagtttttttttagtgaaagaaaagaaaaaagtttttttttagtgaaatgggatattatggtttttagtggtttagggttttggagattgaattttgttgtagtttttattttggggtaaagtgtttggttagttggtgataaaagagtttgtttgtaggtgtgtttggggagttggggagggggtgtgtgaggtttggagggtttttgggttttttttaggtgaatttgagaagagataggaagatagtggttggatgtgtgtttaggtttgtgttgttgtggattgtggagttgtgtagaagtgtggtttggtgggtggtataagtttgatagttgtgttgtgtagtttgtttgtgtttggttaagagttttgtgagggtgtggggagaggattggttttgtagggagtggaggttgtgtggttgtattggattttatagttttaagttgtggtatgaggtgaattttgtaaagtgtgtttttgttatgtattgtttgatttttagtattgtgtgtagtaggattttggagtttatttgtttgtggaaattgagtttgtagtgggaaggtagtgggtggagggtgggtaggtaggggtttggggtttgtggttttttatttttgtgtttttttgtgttagttttgaatgtttttttggggtgtttttgtttagttgttttggttgattttgttttgtagttagtttgaggttaggtggttgttttttgtaggttataaatttttggtgtaaaagtagggttttgaatgtgatattgtattagagtgtttagttaagtgagttgtttttatttttattgtgttgggtggtgtaaattgtgggtgtaggtagaggagttgtggttttgtgttgggtgggagttgaagtttagagttttgttagggtttttttgttgagtgtatttattgttgttgaggtagagtgtggttagtatgaggattagtatgattatgattttggtgtttatggtgtgggtgggtgggtgggtgggtggatgagtgtgggttgggggttggatgttgagtgggtaatgtggttgatggagagtgaaagtgtggtggtgggaggtgtgtgttgggtgttttagaggggagagttaggtggggtggggtggggtgtgtggtgaggggtgggtttggagttgagtgttggttgtggttggggtttttgatgtgtgatttttttggtggtattttttatttattttttttgttttttttttgttttttttgtgtttttgaggtgtagtgtgttttggtttttgatttttttaggttttgttgggttttgtattgttggtttggtttgtagtgaggtttgtagtttgagtgatgttggttggagggttgtttattgtttttgtgatagggttttattggagagattgaggattttaggtgtaaagtggggtgtgtgtggaaagttgtgggatggggttttttgatggtgggaattgaatgagaattaatgaaaagtaaataagttagttttgggtggagggtttgttggtggtggtggtttaaggtagttgagggggttttgttttttgtgtgtgggggtttaagtttgttatttgtttggtttgtggtgtagttgttggtagagtttgatttgtgggaatgagatttgtttttgtagttagtgtggtttggattttaagtttatggtgttattagttgagttttagtttttttgtttgtataaataaagtagaaggtgttggtggtttttagtaaaagtgaatgtagtttttgtatttttgattttttaatggtgaaatgagttaattataggtttattttgtggagtgggatgggagatttaatgagatttgttttatgttgtgaaattttttgtattgtgtttgataagtagatagtatttaataaatggtagttgtaagtaagttttttaaatttaagtatttattgttttatttaagaaaagttttgtgtgatttaaagagttgagaatttttttattttgatttttgatttttaggatagtattattggtgtttgttttttgggtttagaaaattttttttatggagttgttttttggtggtgtttagttttttggatatttttgagatattttagatggttttagtttggtggtgaagggagggtgtaggttggtatttaggagatgtgggggtgaggagagtgtttttttgggttttgttttgtgattgtaggttgttttagttatttttttgtgttttttttagtatagtgtttagtgaagtggggttagttgttgtgtttatttaggggtttgttttggggatatgtttttgtttttggggagttttggttgttggggagtgggtggttagtggttgtattaggtgggagtggttaataggaggttgtgagggttttggaattttgttggtgggagtaggtgttttttgtgtattttttttttaaaattattttggttgttagatggttgtgggttggtattttatttatttatttatttatttatttatttatttatttatttatttatttattttgggtattgggtttggagttgggaattttattgatttggttttgtttttaaagaattgaaggtagtgaggtttagtgaagaaggtagttgttgggtgtttttaggtttttgttgggttgggttggggagtttggttgtttattggttgtagtgttggggttttggtgttttttggtggtggtgtttttttttttgtttttagagttttggttagttttatttttgtgtagttgatgaaatttgggagggtgaaggggtttgtgggaaatttatatttgggtggaggggtgttttggagtttggagatttgattttgtgggagttgtgtgtagttttgtttgtttttaaatttggttaaagtaaatgttattgttttttgttttttttttttttttttttttttgttataaaattaggtgggtagttggatttaggatttgttttagaagtttgaaaggtttgtgtgggttgagttgagggtgaattagggatttaggtttggttgttgttttttttgtaggtgttttgaggttttagaatagaagttattgtggtatttatggggttattttttttgttagttgtttgttaaatatttattgagtatttattatgtgttagatttgggttatatgtttgaagtagtttagaaaaggtattaaatgtttagaagtatatggtgttaagtataagtaattatgtataaaatatttagaaggttattaaatgttaggggaagatggagtagaggaaagtggggtgggagttaggattttaaatagggtggttaaggatttatattttaggtataagttttataattttataattggtgattgaaatttaaaattttggttgggtatggtggtttatgtttgtaattttagtattttggaaggttgaggtgggtggattatgaggttaggagtttgagattattttggttaatatggtgaaattttgtttttattaaaaatataaaaaaattagttggttgtggtggtgggtgtttgtagttttagttatttgggaggttgaggtaggaaaatggtgtgaatttgggaggtggagtttgtagtgagttgagatggtgttattgtattttagtttgggtgataaagtgagattttgttttaaaaataaataaataaataaatatgtaaataaataaataaatatgtaaatatgtaaataaaataaaataaaattttgtatattttgggggtttttgtattgtttgtataggtaggtggttattagattaggttattttgatatgtttttagtttatttggttataggggtattttttaaatttgggttagtgaagttttttatttttttttttgtgttttttgtttatgtttatgtttaaaaggttttatttttttttttttgtttggggatttttattttttatagagttttatttttttttgaagtttttagattttgtgttgttttattaggtaatgtagggtatagtggttttttagggatgttttgttaagtatagtttaaggtgggaggtaggggtttggttgttgagttaaaggtagggtattttttgagttggtatgtgtgttatggtttttagatttttaggtagtatttgtttatttttttttgtttggtttgggttgtttatttttttagggtttaatggttgggtttgtaagagggtttttagtagggattgaaggtttatattaaatttatgttgtatagtgtgtaattgataaggtgattttaggtggtattttgaaatttataaaatatagatttatgtatttatttttttaaagtaataagaaaaaatataattagtatagtaaaggtagatattttagatattgtttaggttttttttttaatatatggtttaagttttaaaaagtaagttaattgaagttaatatagtaagtgttagtttaggtggttggagatatagtaaaaattttgatagtaatataaatagatttgaaatttgaaaattttttttatatgaagaatattttttgtattatttgatatttttttattgtaattttttttttgaaataagtatttggttttaaagtgttgaaatataaaattatataagggaggtatgatgttttttttatttgtttgttaggtgaggttggagaatgttggtttaggagtgtttaggttataggaagattgtggggttttatgggatttttggatatttttggttttgttatttttttaggagtgttttttttttagtttttgtgtagttttggagggattttttttaattatttatatttgtttttatttttttggtatttggttttggggtttaggagtagatggtttattttaggaattaggaagtttggtgaggaagataaatttttattgttttgttgatgttatttgtgtagtaggtatattagttgatatggtggatttggttagtgtgaaattatttggtttagagaaggtttttaggaagatattgaatagtggatttatataggattttagtttgttttttttgaatttgttaatttggtatttttaaagattgagtttgtagtataagttttattgttttagttttgaagatatggaatttaagtttttatgggttttgagtttaaggtttagagttgagggttttggttaatatgatagagttaggtaggagtaagggtatatttttttggggttaatgtttttggattttggaatattagttaggttttgaaagtatttttggggatataagttatttttatggtagttatttagggagttttttggaattttgtatttagggttaggatttggtatttgattagttggttatgttttttttgtttagatttttattggttttaagagttagttgtaaatagttttaggttgttttagagggaaggatttttgggaggtagagttgatttttattggttttgggtatatgtgtgggtaagtaaggtttattgttagggtatgtgtatgtttagtaggttaggatttttgtttgagtaggttttgtttaaagatttttttgttggatagtgttgaggtagggggatttgagaatgtaagaataataaatttagtttttttttatttttataatataaaatatttttgtgattttagatgtgtgtgtgtgtgtgggggggggggtggggattttttatatataaagttagtagttttttagttgtagatattagttggttgttttttaatttaatttaattttgagatgatttatttggaggtaggtttaggttttatatgttgaggttttagttttataaggttgtttttattttagatattagttgtaagttttgggttgtttttttagtgtttttgattaaatgattataaattagggtttttatgattttatttttgggttttattaatttgttattatagtttatggaatttagggaagtatttatgtttattggtttattaaaaagggtattatgggttgggtgtggtggtttatggttgtaattttagtattttgggaggttgatgtgggtggattatttgaggttaggagtttaagattagtttggttaatatggtgaaattttatttttattaaatatataaaaattaattgggtttggtggtgggtatttgtaattttagttatttgggaggttgaggtaggagaattttttgaatttgggaggtggaggttgtagtgagttaagattatattattgtattttagtttaggtgataagagtaaaattttgttttaaaaaaaaaaaaaaaaggatattatgaaggttataggggaagagatgtatagggtgaggtatgggggaaggggatatgaagtttttatgttttttttaggtattattttttaggaatttttattgttgtgaagttttttgaattttgttttgttgtgtttgtatagaagtttattatataggtatgattgattatattattggttattggtaatttagtttttagttttgtttttttttttagaggttgatggggtggggttataagtttttgttttttaattttgtttggtttttttgatgattagtttttattttgaagttatttaagggttgttagttattagttaagtaaattaaagattttaggagttgtatgttaggaagttgggataaagattaaatatatattttataatagtatagttggtattttttgggatattttttgggattgttggattattagggtttatagggtaaattagatttaaggttttaggggtttagatttgtgtttttagtttttatattagtttttaggaattaagtagtgaattttttttgtgtttagttattatagttaggtttggattttttttgttttttttttttagttttattttttttttttattttttttgtttttgggtagattggatttagtagttggggatttattgaaggtttttatattggagtatatattagtttttatttattagaaattttagagtgtgtatattgagagtgtgaatagtattgatattggagttattttgtgttgtgtgt

SEQ ID NO: 90 - DNA, 8788 bp, Artificial Sequence
  chemically treated genomic DNA (Homo sapiens)
gtatgtagtatagggtgattttagtgttaatgttgtttatatttttagtgtgtatattttggggtttttgataggtaggaattgatgtatattttagtatgagaatttttagtggatttttagttgttgagtttagtttgtttagaggtaaggggaataggagagaggggtggggttaggaaagggaggtagaaggaatttaggtttgattgtggtgattgagtataggaagggtttattatttggtttttgggaattggtgtggggattgggagtatagatttgaatttttggggttttgggtttgatttgttttatgagttttggtagtttgatagttttggggaatgttttaggaaatattaattgtgttattgtgaaatatatatttggtttttgttttagttttttggtatgtagtttttaaaatttttggtttatttgattgatggttggtaatttttgggtagttttaggatggaggttagttattagaaagattaagtaggattagaaggtgggaatttatagttttattttattagtttttgaggaaggaaatagggttgaaggttaagttattaatgattagtaatgtaattaattatgtttatgtaatgagtttttatataaatataataaagtagggtttagagggttttatgatagtggaggtttttggaggatggtgtttggagagggtatggaggttttatgttttttttttttatattttgttttatgtatttttttttttgtagtttttataatatttttttttttttttttttgagatagagttttgtttttgttatttagattgaagtgtagtggtgtgattttggtttattgtaatttttgttttttgggtttaagagatttttttgttttagttttttaagtagttaggattataggtgtttgttattaagtttagttgatttttgtatatttagtagagatggggttttattatgttggttaggttggttttgaatttttgattttaggtgatttatttatattagttttttaaagtgttgggattatagttgtgagttattatgtttagtttataatattttttttaataaattagtaaatataagtgtttttttgagttttatgagttgtggtagtaaattaatgaaatttaaggatggggttatagaaattttaatttatggttatttggttagaagtattgggaaaataatttagggtttgtaattggtatttgaagtaggggtagttttgtgggattggggttttaatatgtggggtttgagtttatttttaggtagattattttagagttgaattgaattagaagatagttagttggtgtttgtagttgaaggattattggttttgtatgtggggaatttttgtttttttttttatatatatatatatatttgaagttataaaagtattttgtgttgtgagagtaaggagaaattgagtttgttatttttatatttttagatttttttgttttagtattgtttagtaaggaagtttttgggtagagtttgtttagatagaagttttggtttgttagatgtgtatatattttgatggtaagttttgtttgtttatatatgtgtttagaattagtggggattagttttgttttttaggggtttttttttttagggtagtttggggttgtttgtaattggtttttgaggttagtggggatttagataggaaaaatatggttagttggttaaatgttaagttttggttttgggtatgggattttaaaaggttttttggatgattgttatgggagtgatttatgtttttaagagtgtttttaggatttggttgatgttttaggatttagagatgttggttttagagagatgtatttttgtttttgtttggttttgttatgttggttgaggtttttaattttgagttttgggtttagagtttatggagatttgggttttatgtttttaaagttgagatagtggggtttatattgtaagtttggtttttgaaagtattaaattgataaatttaaagaaggtaaattaaagttttatgtaagtttattgtttagtatttttttaagggttttttttgggttaagtggttttatattgattaaatttattatgttagttaatgtatttgttgtatagatgatattagtaaggtggtgaggatttgttttttttattgggttttttggtttttggaataggttatttgtttttgaattttagggttaggtgttaaaggagtgagggtagatgtgggtggttgggaggggtttttttaggattgtatgggagttgggagaggagtatttttggaggggtggtagggttaagggtatttagggattttatagggttttatagtttttttatgatttgagtgtttttggattagtgttttttagttttatttggtaggtaagtgaggaagatattgtgttttttttgtgtgattttatgttttagtattttggagttaaatatttattttaagagggggattgtggtgggagggtgttaagtaatataaaaaatattttttatgtagaaaaggtttttaaattttagatttatttgtattgttgttaaaatttttgttatgtttttagttatttagattagtatttgttatgttagttttaattgatttattttttaaaatttgaattatatattaaaaaaaaaatttgagtaatatttgaaatatttgtttttattgtgttagttatatttttttttattattttaaaaaaataaatatataaatttatattttatagattttagagtattatttgaagttattttgttaattatatattgtataatatggatttagtgtaaatttttaatttttattgggaatttttttgtaggtttagttgttgggttttggaggagtgaatggtttaggttaggtagaggggggtaggtagatgttgtttaggggtttagagattatagtatatatgttagtttaggagatgttttgtttttaatttagtagttagatttttgttttttattttgaattgtgtttaataaggtatttttgaggagttgttgtgttttgtattatttggtagagtggtatagagtttgaagattttaggagaaggtggggttttatggggagtaagagtttttaggtagagaaagaaaggtggagttttttgagtataagtataagtaaaggatatagggaaaggggtggggaattttgttgatttgaatttgagaggtatttttgtggttgagtgagttggagatatgttaaaatggtttggtttgatggttgtttgtttgtgtaggtggtgtggaggtttttagagtgtatagggttttattttattttatttatatatttatatatttatttatttatttatatatttgtttatttatttatttttgagatggagttttgttttgttatttaggttggagtgtagtggtgttattttggtttattgtaagttttgttttttgggtttatgttatttttttgttttagttttttgagtagttgggattataggtgtttgttattatggttggttaatttttttgtatttttagtagagatggggttttattgtgttagttaggatggttttgaatttttgattttgtgatttgtttgttttggttttttaaagtgttgggattataggtatgagttattgtgtttggttagggttttaaattttaattgttaattgtaaaattgtgaggtttgtatttaaaatatggatttttggttattttatttaaaattttaatttttattttatttttttttgttttatttttttttagtatttaatggttttttaagtattttatgtgtaattatttatgtttagtgttatgtgtttttaaatgtttagtgttttttttaaattattttaaatatgtagtttaggtttagtatatagtgggtgtttagtaagtatttaatgaatgattagtggaagggatggttttatgggtgttatagtagtttttgttttggggttttagggtgtttgtgggaggggtagtggttaggtttgaatttttggtttgtttttgatttagtttatgtgggttttttaggtttttgggatagattttaggtttagttgtttatttgattttgtggtaaagaaaaaaagaagaagaagaagtgagaggtgatggtgtttgttttggttagatttaagggtaagtgaggttgtgtgtggtttttgtagggttggatttttgagttttagggtgtttttttatttgggtgtagattttttgtggatttttttgtttttttgggttttattagttgtgtaggaatggagttggttagagttttgggagtggggagggaggtgttgttattagagggtgttggagttttagtgttgtggttggtgagtggttaggttttttggtttagtttagtaaaggtttggggatgtttgatggttgttttttttattggattttattgtttttagttttttaagagtagggttaagttagtggggtttttggttttaagtttagtgtttagggtgggtgggtgggtgggtgggtgggtggatggatggatggatggatggatggagtgttggtttatagttatttaatggttaaagtggttttggaaaaaaaatgtatagaagatatttatttttattagtggagttttggagtttttgtagttttttgttgattgtttttgtttaatgtagttgttgattgtttattttttgatggttaggattttttagggatagggatgtgtttttagggtaggtttttggatggatgtggtgattgattttattttgttggatgttgtgttgggaaggatatagagaggtggttggggtagtttgtggttataaagtgaggtttaaaggggtgttttttttatttttatgttttttgggtgttgatttgtattttttttttgttattggattggggttatttgggatgttttgggggtatttggagggttaagtattgttgagggatggttttgtgggaagagttttttggatttagaaggtagatgttagtagtattgttttaggagttggaggttggggtgggggagtttttagttttttgggttgtatggagttttttttgggtaaggtagtaagtatttaggtttaaaggatttatttatagttattatttattgagtattgtttgtttgttagatatgatgtagagaattttgtggtgtggggtgggttttattgaattttttgttttattttgtggggtgggtttgtgattagtttattttattattgagaggttggaagtataaaggttatatttgtttttattgagagttgttggtgttttttgttttgtttgtataggtgaggaaattgaggtttggttggtggtgttgtgggtttggagtttgagttatgttgattgtaaagatgggttttatttttgtagattgagttttgttggtggttgtgttgtaagttgggtaggtggtgagtttgagtttttatgtatagaaagtaggatttttttggttgttttgggttgttattgttagtaggttttttgtttgggattaatttgtttgttttttattggtttttatttagtttttgttattgaaaggttttgttttgtagttttttatgtgtgttttattttatgtttaaggtttttagtttttttagtggggttttgttatagggataataagtggttttttagttggtgttgtttaggttgtggattttattgtagattgggttagtggtgtggggtttagtggagtttgagaaggttaaaggttggagtgtattgtgttttgggagtatagagggagtggaggaggggtgaaggggatgggtggggggtgttgttgagggagttgtgtgttagagattttggttatggttagtatttggttttgggtttgttttttattgtgtgttttgttttgttttgtttggtttttttttttaaagtgtttggtgtgtgttttttattgttgtatttttattttttgttagttgtattgtttgtttggtgtttggtttttgatttgtgtttgtttgtttgtttgtttgtttgtttgtgttatgaatgttaaggttgtggttgtgttggtttttgtgttgattgtgttttgttttagtgatggtaagtgtgtttggtggggaggttttggtgaggttttgggttttggtttttgtttggtgtagagttgtggtttttttgtttgtgtttgtagtttgtgttgtttgatatagtgggggtggaggtagtttgtttagttgggtgttttggtgtggtgttgtgtttaaagttttatttttgtgttgagggtttgtgatttgtagagagtgattgtttgattttaagttggttgtagagtgaggttagttgggataattgggtaggaatgttttaagagagtgtttgggattggtgtgggaaggtgtgagggtggggagttgtggattttagatttttgtttgtttattttttatttattgtttttttgttgtgggtttggtttttataggtgaatgggttttgaggttttgttgtgtatagtgttggaggttgggtggtgtatggtgagagtgtgttttgtaaagtttgttttatgttgtgatttgaggttgtgaggtttgatgtagttgtgtagtttttgttttttgtgaagttgattttttttttatatttttgtggggtttttggttaggtgtgggtgggttgtgtggtgtagttgttgggtttgtgttatttgttaggttgtgtttttgtatagttttgtggtttgtagtgatgtggatttgggtgtgtgtttagttgttgtttttttgtttttttttgggtttatttgagagaggtttagggattttttgagttttatatgttttttttttagttttttaaatatatttgtagataggtttttttgttattagttggttaagtgttttgttttagaatgagagttgtagtaaagtttaatttttaaggttttgggttattgggaattgtggtgttttgttttattgggagagggtttttttttttttttttgttgaagagaaatttgttgtgttgttataggatattgatgtaaattaaaataaattgttgtttttgaatatataaaataaaattttgtggtttaggttgttgagtttttttggttgtgaagttttttgtaaagagttgaaggatattttgagtgtttttgtagttgtgggttgtgtaggtttagtgtgttttgagtttttggttgggttggtgtagatgtggttttggtgttttagttggtttggattgtgtgttggtgtgagtaggattagtgtagttgagttgggttggagaagttgggtagtttggggttgtggtggattgtttaagtgttaaggatatagattgaaggtaattgggaatgtttgttgttgatgaaaagtttttgaggttgtgtttgtatattgatttttttttttttttgtaagttatggggtatgtttttagtttttattgttggatatttttttgtttttgtaaggtttttggtttgggtagttattgattgattggtgggatgagtgtggaggtgttatagtgtgttgttttgggaaatggtgttgttttttttttggagggttggagagaggattggaatgaggaattttggtttttgagttatgggtgtaattgatttgggggaagtatagagatgtggggtttattttagattttttttggtttgggaagggtgatatggtttttagagttgttttattggtagttaagtaattagggtaggagtttgggttttaggtagatttgttttttatatatattgttagaatgttttgttttgttttgttttttttttattttatagtgtttatgtgttttttatttttatatttagtttttaagttgtattatagagagagtttggttaggggttttgttttttttttattggttgatttttgttaggtagttgggtttttgggttttttgggtttaaatttagggtgggttttttttttaagtttgtttggaggggttagttgggtttttgtttttgtattagattggagggttttttgaaaatttttggagttaagtttatttggttttaaatttggggtattattagagttagttaggatttttgttggtatatggatttatatttagaatggttgggaaagttagttttattgataaaaagttggaggaaggagtatatgaggtatatatgagattatgtttttttggtaagtatatttgggggttttgttattttaaaaagatttgttgaaatttgttgtttgataggtgggttttaggttttgggagtagaagtaagaattgtttttgaaggaaatggataattttagggggtggagggggagaggagagagagtttgtgtgttgagttttgaataggttttgatttttggttttattattattgtttggttggggggttagaggagttttttttttttgggtgttggagagttatagttttatttattttagtgggggtggttgtagtatttgtttttggttgtatatttttaagtttattgttgttgggagggggtttgtgttttattattggttttttatttttttgttttatttttaatttattttttgttttagtttggaagggtttaaaagaaatttagggaaatttggaggtataatatttaggagtgtttagttttttagttatttaggttgtaggttttggt

SEQ ID NO: 91 - DNA, 13114 bp, Artificial Sequence
  chemically treated genomic DNA (Homo sapiens)
tgggaaaggggttagggtatagaagtaagggattggggtgtagagataagaggttggggtgtggaaataagggattggggtgtagagataagatgttagggtatagaaataagggattgggggatttttgttttttagaaaagtggtatttgttattaagggtgaaggagaaggggttggggggtttttgtttttttagaaaagtagagaaggggtagagatatagagaaggagttgggggtttttgtttttttagaaaagtagtatttgttattaagggtgaaggattaaggtaggtatttttatgtggttagatatttttgaaatgtgggtgaataattagagaggtgtttttgtgtgattaaatattaagggaaggttgtttttttgagtttatgattggtgttggagttttgggtttatgaataaagtgtgttttttgtttttattagaaaaggaaaggaattgaaattaagagaagggagagattgaagagtggaaaggagaaagtggttgagggatagtgagagaggttggagaagagagtaaaaagaggttgtttattggatttaaaattggtgagatgttttttgggttggttggtttgaggatgagaggttgtaggtggattttttttatggagtaaagagtaggaggataggggattgattttttaaggaagattttttgatttgagttatggtattaaattttatttatgtttgtgtgaagagattattaaataggatttgtgtgagtaataaggttgtttattttatttgggtgtaggtgggttgagtttagaaagagagttagtaaagggagataggagtgtggttgttttataggatttgggtaggtaaaggaaaattatagttaaaagggggttgttttttggtgggtaggagtggggtttataaggtgtttagtaggggagtttttgagttgggatgagttaggagaaggaattttataagataatgttattatttaaggtaagaataggttatttttattttttttgtggtggaatgttattagttaaggtaggaattggttatttggatgtgtatatataggttatagggggatatgatggtttagtttgggtttagaggtttgatagtttggattatttgatttggtgatttgtatattttggttttttaaagtgttgggattataggtatgatttattgtatttggttttagaaaattttttaaatattaaaatgtatgttatgtgtattttgttataatttttgaaaagtattttttggtgtttagagatagaagatgagtggttgtttagggttgggagagtgaggggattgtggtgatgggtagttggttggtatggggttttgaagggtagtgatgataatattttaaaattagattgtgttgatggttgtattaattttgtgaatattataaaatttaaattattgaattatgtatttttaatgggtaattgtatggtatgtaaattatattttaataaagttatatttttaaatattaaaaaaaggttgggtgtggtggtttatgtttgtaattttagtattttgggaggttgagaagggtggattatgaggttaggagatggagattattttggttaatatggtgaaattttatttttattttgaaaaaaaaaaaaaaaaaaaaaagattatttggatgtggtggtgggtatttgtagttttagttatttaggaggttgaggtaggagaatggtataaatttgggaggtagagtttgtagtgagttgagattgtgttatttaggaggttgaggtaagagaatggtataaattttggaggtagagtttgtagtgagttgagattgtgttattgtattttagtatgggtgatagagtaagagtttattttaaaaaaaaaaaaaaaaagattagtaatattttttgtgttatttattatttaagtgattgaattatgatttgaaatttattattttaaatatggtttagagtttgtagaggggggatagttttaggaatgttggtgtgggtttaaggttgaattaaatagatttagatggtttatatttgtaattttaatattttgggaggttgaggtaggtgggaggttgaggtaggtggattattggagtttttggagtgaagaaaggatgttagtggaaaaattggtgaaattagaataaagtttatagttttattttttaaaggaggttgggtgtggtggtttatgtttttaattttagtattttgggaggttgaggtaggtggattagttgagtttaggagtttgaaattagtttggttaatttgatgaaattttatttttattagaaatataaaaattagttgggtgtggttgtgggtgtttttaattttagttatttaggaagttgaggtaggagaattgtttgaatttaggaggtggaggttgtagtgagttgagattatattattgtattttagtttgggttatagagtaagattttatttttaaataagagagatatgataattaaataaattgtgtaattttggattaaattttaaattaaatatatgttattggtaaaataagtggtgaaatttgaataaagtggatagattagataatagtgttatattagtgttattttttgattttgaatattaataatagaatgtttttggttttgggaaatataatttgaagtgattagaggtttagggtattatatgtaaattagatatattttttttggggagagagggagagggagagaggttgaatgatgaagtaaatgtggtaaaatgttaattttggggaaatttggatgaagaaattatagattttttttttttttatagatagggtaatattttgttatttaggttagagtgtagtggtatgattatggtttattgtagtttttatttttttgggtttagatgatttttttattttagttttttaagtagttgggattataggtgtatagtattatatttggttaatttttgtattttttttttttttaggtttgttttaagtaatttatttattttggttttttaaagtgttgggattataggtgtgagttattgtatttggttagaaattttttaaattatttttgtaagtttggaattatgttaaaattaaaagtttaaaataataaaagataatatttttatatttttttggtgaaggtaattatgttatggttgagagggtggttgaggtttgaggatttagtttatataagttttttttatagagggtatttaagtgttttgtagggggaaggataaagaaaatatttagagttatgatagttgtgtaaggggaaatgttagtattgagtattgaatttttagtaaataagaaggaggtgggttgggtgtggtggtttatgtttgtaattttagtattttgggaggttaaagtgggttgattatttgaggttaagagtttgagattagtttggttaatatggggaaattttgtttttattaaaaatataaaaattagttgagtgtggtggtatatgtttgtaattttagttatttgggaggttagaataggagaattgtttgaatttaggaggtgaaggttgtagtgagttgagattgtattattgtattttagtttgagggatagagtgagattttgttttaaagagaaaaaaaaaagaattagtatatttgtttgttttaagaagatataattagttttgtatagtagttatatgtatttattaggatatattttaaggttttagtggatgttgaaaattatatagtattttatatgtatatatatatgtatatatatatatatatatatatgtatatgtatatatatatgtatatatgtatgtatgtatatatatatatgtatatatatatatatgtatatatatatgtatgtatatatatatatgtatatgtatgtatatatgtatatatgtatgtatatatgtatatatgtatgtatatatatatatgtatgtatatatgtatatatgtatgtatatatatatatgtatgtatatatgtatatatgtgtgtatatatatatatgtatgtatgtatgtgtgtatatatatatatatgtgtatatatatgtatatatatgtatgtgtatatatgtatgtgtatatatatatgtatggtattatgtagtatatatatatatatatgtatatatgtatatatatatgtataaatgtatatatgtgtatatatataaaaggtatatatgtatatatgtgtgtatatataaaatgtatgaatttttttttttttattgtagattttaataatttttgtatagaatttttttttattaagtggagagttagttatttatttaaaagaaatgttttttggttgggtgtggtggtttatatttgtaattttagtattttgagaggttgaggtaggaagatttatttgaggtgaggagttggagattattttggttaatgtggtaaaaattggtttttattaaaagtataaaaatgagttgggtgtggtgttgggtgtttgtagttttagttatttaggtggttgaggtaggagaattgtttgaatttataaggtagaggttgtagtgagttgagattatattattgtattatagtttgggtaatagagtaagattttgttttaaaaaaaaaaaaaaaagaaagaaaaagaaaaagaaaagaaatgtttttttttttattaagttttttaaatgaaaagtttttttttttatttttattttattgaaatattataatattatttttgaagaagttagtgttattattttattttgatgaaattaattaatttatttaagtatatgtatattgtatatagagaagttaatgttaaaatttttatttttatttttttagatttagtagatatatgtgtaggttttttatgagtatattgtatgatgttgaggtttgtattaatgatttagttattaaataggtagatttttaagttttgtttttttttttatttaatgtttagtgtttttatttataagtgagaatatgtggtatttggttttttttttttttttttttttttttttgagatggagttttatttttgttgtttaggttggagtataatggtattattttggtttattgtaatttttattttttaggtttaagtaatttttttgttttagttttttgagtagttgggattataggtatgtgttattatatttggttaattttgaatttttagtagagatagggtttttgtatgttggttaggttggttttgaatttttgatttaaggtgatttatttgttttagttttttaaagtgttgggatgataggtgtgagttattgtgtttggttagtatttggttttttgtttttgtgttaatttgtttaggataatggtttttagttgtatttatgttgttgtaaaggatataattttgtgattttttaaggttgtatagtgttttgtggtgtatatatattatattgtttttatttagtttatttttgatgggatttgggtggattttatgtttttattattgtgaattttgttgtaatgaatatataagtgtatgtgtttttttggtagaatgatttatttttttttggttatatatttagtgatgggattgttgggttgaatggtaattttgtttgtagttttttgaaatatttttaaattaaattgttttttatagtggttgaattaatttatatttattaatagtgtataagtgttttttttgttttataattttattagtatttgttaatttttggttttttagtaatggttattttgattggtgtgagatggtattgttgagggataatttaggaattagagagattgaggggttgaggaggatttattattattattattatttaggtgtattggttttagttagattaatatttaaaaagattgaggtttgaatagagagtttggttattttttaagtattttgtggggttgggggagatttgtgtagggggaagtatattatagaagtaagaaataaaggtagttatttaattgagatatgtattatattattttttattttttaagaaaaatatgttttatgatttgaggttattttgtttagtgattttgtagttgtatggtaagagaaatagggtttttataatgtttgggaaagggagagataaggtttattagttatagatagaaaaataggtagtttatgtttaaaggattttattttttttttttttttggggggaattgggtttttttaaatataattgagtttttgtttatatattttgtaattttttttaatttttgttttagtattttattgtgaaattttttatgtttttatatgatttttagggggttttttttgggtatgattgggtataattttttatagttagttttgggtatgatttttatattgtagaattgagaagttgatttagaaatgtattttgggttgagtagataattgttagagttgttggttagattatagatgtgttagagggattatggtttttttgtaagtttatggttagaggtggaggggagttgtgaatgttttgatgaaagtagttaatgtgaaagtgttttggtgatgggtgttggtgtttatttattattttttgtgtatttatttttttggtttgtttggtttagtttttattgtttagtattaggttggtagaatttgagtgatgttttttatattttttgttttgttttgtgttggtgagttttggtgtggaaggggaatgggattatggtgtgtttgggaggtaataggttttattatttttgttttttagggttgtgtttgagttagaggattagtgtttagtagtgtgagttttttttttaaagtttagggttatttttttgggtttaggttaagttttttttatttaagtatggttggggagaggggatagggtgttggttttttaggagagtttggggttagtagttgggtggagtttaaggttggggggagggggttttgttggaattttagtttttgatttttttttagagatttttttaaaattgtttatttgggttgagttttattttatggttttaaaggaaaagtaagtgattatttgttgttagggaaattatggggttgttgaatattagttgtattttgaaggaagtttttttgttgtggatagattaaaattttttgagtggattaataaagttaaattttatattttggatatgaatttttgtatggtagggtaatatagttgtatttattgggttggggagttttggttagagtttagtaatttgttggatttggtggtaataggtaattgtttggttttttaattggagagtgattttagtttgtatttgggatgtagtattatttatgaatttttttaagttttatttagatattgtttgttttggtaggaggttggaaggaggggtgatttttattataatttttgtttataaggggttgtttgtagattgtgtttttatgttttaggagtagatgtgtttttagttagtttttttatgatatagattttgagatagatatttgtatgtaggggtatgattgaggaatgtttttaaaaataatgtttgtgggttaggtgtagtggtttatattttgttttttttatttattataggtggtgggttttttttttttttatttgttttgagatggagttttgtttttgttatttaggttggagtgtagtggtgtaatttttagttattgtaatttttattttttgggtttaagtgattttttagttttagttttttaagtagttgggattataggtatttattattatgttatattttgtatttttagtagagatggggttttattatgttggttagggtggtgttgaatttttgattttagatgatttgtttgttttatttttttaaagtgttgggattataggtgtgagttattatatttagttaggtggtggttttttaaaaaaaaaaaaaaaaattagttttttttttttttaataatatggttgtttattattattattaagtattatatatagttatatatatatatataattgtatgtgttatataattaggtttgtttatattagtaatattaaaaatatatgagtaatattttgtgttaggaaggttatgatgttattaggtaataggaattttttagttttattataattttatgggattattattatatatgtggtatattgttggttaaaatgttattatgtagtttataatagtattttatgtttatttaaatatttttttttgtgaaatgtttatttaaattttttgtttatttttaaattgggttgtttatattttgattgattaggaaaagttatttttatattttgtgttatatatttgtgttgaaatatatatattttttgtttgtgtttttttatttgtttagggtttttggattttgtttggaggttttggtaggggaatatagttatttatttatttttttttttttaatttttttagtatttattgattatttttgggtgttttttggagagggggatttggtagggttataggataatagtggagagaaggttagtagataaatatgtgaataaaggtttttggtttttttaggtagaggtttttgtggttttttgtagtgtttgtgtttttgggtatttgagattagggagtggtgatgatttttaaggagtatgttgtttttaagtatttgtttaataaagtatattttgtattgtttttaatttatttaattttgagtggatatagtatatgttttagagagtatggggttgggggtaaggttatagattaatagtattttaaggtagaagaatttgttttagtatagaataaaatggagttttttatgtttatttttttttatatagatatagtaataatttgattttttttttttttttttatattttttttttttttatttgataaaattgttattgttattatggtttatttttaatgagttgttgggtatattttttagatggggtggtggttgggtagaggggttttttattttttagatggggtggttgggtagaggtgtttttttattttttagatggggtagtggttgggtgggggttgttttttaattttttggatggggtggttggttggggttttttttttttttttttgagatagttttgttgtagtgtagtggtataattttagtttattgtaatttttgttttagttttaatttttttgttttagttttttaagtagttgagattataggtatgtgttattatatttggttaatttttgtatttttagtagagatggggttttattatgttgattaggttggttttaaatttttgatttaggaggttgagtttttagtaagtaaagatagtgttatggtgttttagtttgggaaatagagtaagattttgtattatttttaaaaatggttttagatggtaaattttttattgtgtgtatttgattaaaataataattaaaaaaaaaaaaaaagttggttgttaggtatggtggtaggtttttgtagttttagttatttgggagggtgaggtaggagaaatgtttgaatttgggaggtagaggttgtagtgagttaagattgtgttattgtattttagtttgggtgatagagagagattttatttttaaagaaagaaaaaaaaaaatagttggttgtttattattgagtttttggtgtggtggttttatttttttttatagaaatgtatgatatatttatttttttggtttattttggatttgaagtgattttgggagagaaggtgattttttattgttgtttagatattgtaataagtatgtttttattgtttaaggagggaagatttagttatgtatagtgtggatatgggaaggtttaggtggagttttttttgggttttgtgattatagtttattgagggatatattgatgttttggtttttataataattatgtttggtttttttttagtgagttagtgaagtttttggttataggtgaggaaatgtttaattttttatattttttgttgttatgttttatttggagttttgagggatttttagagagtgatggggagggtgtttaagggatgtttattttttgggtgtttggttggttatgtgaggaagaatattagaagtaggaaggaggagggagtagagaaaggaatggtaaggtgggtggattataaggttaggagtttgagattagtttggttaagatggtgaaattttgtttttattaaaaatatagaaattagttagatgtagtggtggatatttgtagttttagttatttaggaggttgaggtaggagaattgtttgaatttgggaggtgggggttgtagtgaattgagattatattattgtattgtaatttgggtgatagagtaagattttattttaaaaaaaaaaaaaaaaaaaaaaagaatggtaagattggaggaaattaaaaatttttatttttttttttttatttttttttttaggtgatattgagaatattagttttgtatttgaagattttattttttttggtgagtaattggtttttttaagtttagatgagtgattagagttttttagtgatattaaaaatgtggtatttatttaaaatatttattgaggttaggtgtggtggtttatgtttgtaattttagtattttgggaggttgagatggtgtattatttgaggttaggagtttgagattagtttggttaatatggtgaaattttgtttttattaaaaatataaaatttaggttgggtattatggtttatatttgtaattttaatattttgggaggttaaggtggttggattataaggttaggaatttgagattagtttgattaatatggtgaaattttatttttattaaaaatataaaaattagttgggtttggtggtgtttgtttgtaattttagttatttaggaggttgaggtaggagaattgttgaatttgggatgtagaggttgtagtgagttgagattgtgttattgtattttattttattgtatgatatagtgagattttattttatagaaaaataaaaataaaattattatatatatatatttattaagtgtatagtatatatagtgaattatattgtaatagttagttaggtagatattttgattttgtagtatttagattttagtaggaggagatatattattggttaatgttaggatagtatataggagggaatgatgttatggaaggaaaagataaagtagaatagatttatagtgattgaaatggtagttagtaatattaaataggtttgtttagatggattttatagagaaagaaggtatttgagtaaatgtgtttagatttgagttaattatgtggttgttaggagaaaggaggttttggagagaatgaaatggtatttgtttgtgttttggggtaggaagataattggggtaatataataataattatgaggttaggagggttgaaaatgatgtttggaagatgatggtgggatgggtttggggtgtatggttaggattataggagtgaggtttggtgtggtggtttatgtttgtaattttagtattttgggaaattgaggtaggtgggttatgaggttaggagattaagattattttggttaatatggtgaaattttgtttttattaaaaaaaaatataaaaattatttgggtgtggtggtgggtgtttgtagttttagttatataagaggttgaggtaggagaatggtgtgaatttgggagatggagtttgtagtgagttgagattgtgttattgtattttagtttgagtgatagagtgagattttgttttaaaaaaaaaaaaaaagaaaaagaaaaagaaaaaaaaatagtgagattttgaattttattatgtgtgtatgtgtgaggagaaagaggtaatgatgatttaatgaggaaaatgaggtttaaatagaagatgggttgggttgggtggtttttgtatgtaattttagtattttggaaggtaggggtggttggattatttgaggttaggagtttaagattagtttggttaatatagtgaaattttatttttattaaaaatataaatatgagttgggtgtggtggtgtatgttagtaattatagttatttggggttgaagtaagaggattgtttgaatttgggaggtggaggttgtagtgagttgagattatattattgtattttagttttagaggtttgttattttagttttttgggaggttgaagtaggtaggttatttgaggttgggagtttaagattagtttggttaatatggtaaaattttgtttttattaaaaatatgaaaaaaattatttgggtatgtggtgtgtgtttgtagttttagttattttagaggttggaatatagtgagattttattttaaaaaaaaaaaaaatagaagatatgattggtgtaaagatatatgtttataagtgttagaatggaattttttgttaggtttgtttatttgtggatttttttattttatttgttggatgaagtttttgggatttgtagggtgaggtgggattttgtaaagttgtagaatgttatggggtagatttaagggaaggagtgttggggtggaggaggttaaaattatttttttttttttattttttttattattagtagatatttggggtatttattttttaattatagagatgggattttagaaaggtaagtagatagttggggttataggttttgaaggaaggggttgggtatagagtagatttaggaagggaatttaaatgggaataagagggtgtttttggttaggtgtagtagtttatatttgtaattttagttttttgggaggttgaggtgggtagattatttgaggttgggagtttaagattagtttggttaatatggtgaaattttatttttattaaaaatataaaaaaattagttaggtgtggtggtgtgtgtttgtagttttagttatttgggaggttgagataggagaatagtttgaatttaggaagtggaggttgtagtgagttgagattgtgttattgtattttagtttgggtg

SEQ ID NO: 92 - DNA, 13114 bp, Artificial Sequence
  chemically treated genomic DNA (Homo sapiens)
tgtttaggttggagtgtaatggtatgattttggtttattgtaatttttattttttgggtttaagttatttttttgttttagttttttaagtagttgggattataggtatatgttattatgtttggttaatttttttgtatttttagtagagatgggattttgttatgttggttagattggttttgaatttttgattttagatgatttgtttgttttggttttttaaagggttgagattataggtgtgagttattgtgtttggttaaggatatttttttgtttttatttagattttttttttaggtttattttatgtttagtttttttttttagagtttatggttttagttgtttatttatttttttggagttttgtttttgtggttaaaaggtaggtgttttaagtgtttgttgatgataagggaagtgaagaaaagaggatggttttgattttttttattttagtatttttttttttgggtttattttatgatgttttgtagttttataaggttttattttattttgtgggttttaggagttttatttagtaggtaaagtggaagggtttatagatggatgaatttgatgaggaattttattttagtatttgtgagtatgtgtttttgtattagttatgttttttattttttttttttttgagatagagttttattgtgttttagtttttggagtagttgggattataggtatatattatatatttaggtaattttttttatatttttagtagaaatggggttttgttatgttggttaggttggttttgaatttttaattttagatgatttgtttgttttggttttttaaagggttgggatgataggtttttgaggttggagtatagtggtgtgattttagtttattgtaatttttgttttttgagtttaagtaatttttttgttttagttttgagtagttgtaattattggtgtgtgttattatatttaatttatgtttgtatttttagtagagatggggttttattgtgttggttaggttggttttgaatttttgattttaagtgatttagttgtttttgttttttaaagtgttgggattatatgtgggagttatttggtttagtttgttttttatttaagttttattttttttattaagttattattatttttttttttttatatatatatatatagtgaaatttaaagttttattatttttttttttttttttttttttttttttttttttttgagatggagttttattttgttgtttaggttggagtgtagtggtgtgattttagtttattgtaagttttgttttttgggtttatgttatttttttgttttagttttttgtgtagttgggattataggtgtttgttattatgtttggataatttttgtatttttttttagtagagatagggttttattgtgttagttaggatggttttgattttttgattttatgatttatttgttttggttttttaaagtgttgggattataggtgtgagttattgtgttgggttttatttttgtaattttagttgtgtgttttaggtttattttattgttattttttaaatattatttttaatttttttggttttatagttattattgtattattttagttatttttttgttttagggtataggtagatgttattttattttttttagagtttttttttttttgatagttatatgattaatttaagtttgaatgtatttgtttagatgttttttttttttgtgaggtttatttggataaatttatttaatattgttagttgttattttaattattgtaagtttgttttattttgttttttttttttatagtattatttttttttgtgtgttattttgatgttgattgatggtgtgtttttttttgttagaatttaagtgttgtagagttaagatatttgtttggttgattgttatagtgtagtttattgtgtatattatgtatttgatgaatatatatatataatagttttgtttttgtttttttgtgagatggagttttgttgtgttgtgtagtggagtggaatgtagtggtgtgattttagtttattgtaatttttgtattttaggtttaataatttttttgttttagttttttgagtagttgggattataggtgagtattattaggtttggttaatttttgtatttttagtagagatggggttttattatgttggttaggttggttttgaatttttgattttgtgatttaattattttggttttttgaagtgttgggattataggtgtgagttatgatgtttagtttaagttttgtatttttagtagagatagggttttgttatgttggttaggttggttttaaatttttgattttaaatgatgtattattttggttttttaaagtgttgggattataggtgtgagttattatgtttggttttgatgaatattttgaatgaatgttatgtttttagtgttattgggaggttttgattgtttgtttgagtttagaaggattagttatttattaggaaaggtggggtttttaggtgtaaggttggtgtttttaatgttgtttggaaaaggagataaagaaaaaaaagtaagggtttttggttttttttggttttgttattttttttttttttttttttttttttgagatggagttttgttttgttgtttaggttgtagtgtggtggtatgattttggtttattataatttttgttttttgggtttaagtgatttttttgttttagttttttgagtagttgggattataggtgtttgttattgtgtttggttaatttttgtatttttagtagagatggggttttattgttttggttaggttggttttgaatttttgattttgtgatttatttgttttattatttttttttttgttttttttttttttttgtttttggtgtttttttttatatgattaattaggtatttaggaagtggatgttttttggatattttttttattattttttggggattttttagggttttaggtaggatatggtggtgaagggtgtggggaattgagtatttttttatttgtgattaggagttttattggtttattggggaaagattaggtatggttgttataggagttaaaatattggtatgttttttggtgggttgtggttatagggtttagggggaattttgtttggatttttttgtatttgtgttgtatgtggttggattttttttttttgagtagtaagaatatgtttgttgtagtgtttagatggtagtagaaggttatttttttttttgagattattttgggtttaggatgaattgagagggtgggtgtgttatatatttttatgagagaaggtggggttattatattagaaatttagtgatgagtagttagttatttttttttttttttttttagagatggagtttttttttgttgtttaggttggagtgtagtgatatgattttggtttattgtaatttttgttttttgggtttaagtgttttttttgttttatttttttaagtagttgggattataggggtttgttattatgtttggtagttagttttttttttttttttaattattattttggttaaatatatataatagaagatttattgtttaaaattatttttaaaaatgatatagggttttgttttgttttttaggttggagtgttgtggtattatttttgtttattgaagatttgattttttgggttaggagtttgagattagtttggttaatatggtgaaattttgtttttattaaaaatgtaaaaattagttgggtgtggtggtatatgtttgtaattttaattatttgggaggttgaggtaggagaattgaggttgaggtagaggttgtagtgagttgagattgtattattgtattgtagtgagattgttttaaaaaaaaaaaaaaaaagttttggttagttgttttgtttgggaggttggggggtagtttttgtttggttattgttttgtttgggaggtgggggggtgtttttgtttggttgttttgtttgggaagtgaggagtttttttgtttggttgttattttgtttgggaggtgtatttaatagtttattgagaatgggttatgatgatgatggtggttttgttgaatagaaaaaggggaaatgtggggaaaagaaagagagattagattgttattgtgtttgtgtagaaagaagtagatataggagattttattttgttttgtattaagataaatttttttgttttgggatgttgttaatttatgattttatttttaattttgtgttttttgaaatatgtgttatgtttatttagggttaaatggattaagggtggtgtaagatgtgttttgttaaatagatgtttgaaggtagtatgttttttaagagttattattattttttaattttaagtatttagggatataaatattgtggaaggttgtagggatttttgtttaggaaagttagagatttttgtttatatgtttatttgttgattttttttttattattgttttatgattttgttaaatttttttttttgagaaatatttaagaatgattaataaatattaaaaaaattaaaaaaaaaagaataaatgagtagttgtgtttttttgttagaatttttaaataaggtttaaagattttgagtaaatgaaaaggtatagataaaaaatatatatattttaatataagtatatgatatagaatatagaaataattttttttaattaattaaaatataagtaatttaatttaaaaataggtaaaagatttaaatagatattttataaaagaagatatttgaatggatatgaaatattgttgtgagttgtataatgatattttggttaataatgtattatatatatgatggtggttttataagattataatgaaattgaaaaatttttattgtttgatgatattatagtttttttagtataaagtattgtttatgtgtttttggtgttgttggtataaataaatttaattgtatagtatatataattatgtatgtatatgtaattatgtataatatttgataataataataaataattatattgttaaaaaaaaaaaaagttaatttttttttttttttttagaaaattattatttggttgggtgtgatggtttatatttgtaattttagtattttgggagggtgaggtgggtggattatttgaggttaggagtttgatattattttggttaatatggtgaaattttatttttattaaaaatataaaatgtggtgtagtggtgggtgtttgtgattttagttatttgggaagttgaggttggagaattatttgaatttaggaggtggaggttgtagtgattggagattgtattattgtattttagtttgggtgataagagtgaaattttgttttaaaatagataaaaaaaaaaaaaatttattatttgtgatgggtgagggaagtaaagtgtaagttattgtgtttagtttataggtattgtttttgaggatattttttagttatatttttgtatataaatatttattttagaatttgtgttatggagaaattgattgaggatatatttgtttttaggatgtagagatatggtttgtagataattttttgtaggtaaggattgtgatggggattatttttttttttagttttttattgagataagtagtgtttgagtggggtttggaagagtttatagatgatgttgtattttggatgtagattgagattattttttagttagagaattggatagttatttgttattattagatttagtaagttgttgggttttgattagagttttttaatttgatagatgtagttgtattgttttgttatgtgggagtttatgtttgggatgtagaatttgattttgttaatttgtttagggggttttggtttgtttatggtaaaaaggttttttttaaagtgtagttggtatttaatagttttataatttttttggtaatagatggttatttgttttttttttggaattatgaaatggggtttggtttagatgaatggttttgggagagtttttggaagggaattagaggttggagttttagtggagttttttttttttaattttaggttttatttagttgttggttttaagtttttttgggaagttagtattttgttttttttttttagttgtgtttgggtggaaggagtttggtttgaatttggaagagtgattttgggttttgaaggaaggatttatgttgttgggtgttgattttttgatttagatatagttttggaagatgggagtaatgagatttgttgttttttaggtatattgtgattttattttttttttatgttagaatttattgatgtagagtagggtagggagtgtggaagatattgtttagattttgttggtttagtgttgagtagtggggattgagttgggtgggttagggagatagatatataggaagtggtgggtgagtattagtgtttattattagagtgtttttatgttgattgtttttattagaatgtttataatttttttttgtttttgattatgagtttatagaaaggttgtggtttttttgatatatttgtggtttagttagtaattttgataattgtttgtttagtttaaaatgtatttttgggttaattttttaattttgtaatgtggaggttgtatttagagttgattgtgggaagttgtgtttaattatgtttagaggaaattttttgagaattgtataaaaatatagggagttttatagtgagatattggaataggaattaaaagaaattatagaatgtgtaaataaaaatttagttgtatttaagaaaatttagttttttttgaggaagagaaagaggtggagttttttaaatatgaattgtttgtttttttgtttgtggttagtgagttttattttttttttttttaggtattgtgaagattttgttttttttgttgtgtggttgtaagattattagataggataattttaagttgtaaaatatattttttttgaaaagtaaggaataatgtgatgtatgttttaattgaataattgtttttgttttttgtttttgtaatatgtttttttttgtatagattttttttaattttataaaatgtttaaaaggtaattggattttttgtttgagttttagtttttttggatgttaatttgattggggttggtgtatttaaataataataataataataaattttttttaattttttggtttttttgatttttaaattattttttaataatattattttatattagttagaatggttattattgaaaagttagaaattaatagatgttggtgagattgtggagtaaaggggatatttatatattgttggtgggtgtaaattagtttagttattgtggaaagtagtttggtttggagatattttagagaattataaatagagttattatttagtttagtaattttattgttgggtatatagttaaaggaaaataaattattttattaaaaagatatatgtatttgtatgtttattgtagtaggatttataatagtgaagatatggaatttatttaggttttattagaggtggattggataaagataatgtgatatgtatatattatagaatgttatatagttttgaaaaattataagattatgttttttgtagtaatatggatgtagttagaggttattattttaagtgagttaatatagaaatagaaaattaaatattggttagatatggtggtttatgtttgttattttagtattttgggaggttgaggtaggtggattattttaggttgggagtttgagattagtttgattaatatgtagaaattttgtttttattaaaaatttaaaattagttgggtgtggtggtatatgtttgtagttttaattatttgggaggttgaggtaggagaattgtttgaatttggaaggtgaaggttgtagtgagttgagatggtgttattgtattttagtttgggtaataagagtgaaattttattttaaaaaaaaaaaaaaaaaagaaaagaaaattaaatattatatgtttttatttataagtgagagtgttaaatattgggtaaggaggggagtaaggtttgaaaatttatttatttggtgattagattattaatgtaagttttagtattatgtaatatatttataaaaaatttgtatatgtatttgttgaatttaaaaagataaaaataggggttttgatgttggtttttttgtgtatagtatatatatgtttggataagttaattggttttattagaatggaatgataatattaatttttttaaagatagtgttataatgttttaataaaataaaagtgaaaagaaaagttttttatttaaagaatttaataagaaaagaaatatttttttttttttttttttttttttttttttttttttttttgagatagagttttgttttgttgtttaggttgtggtgtagtggtgtgattttagtttattgtaatttttgttttgtgggtttaagtaatttttttgttttagttatttgagtagttgggattatagatatttaatattatgtttagtttatttttgtatttttagtagagattggtttttattatgttggttaggatggtttttaattttttattttaagtgaatttttttgttttggttttttaaagtgttgggattataggtgtgagttattatatttagttaagaaatattttttttaagtaagtaattaattttttatttaataaaaaaaaattttatgtagaagttgttaagatttatagtaagaaaaaagaaatttatgtattttatatatatatatatatatatatatatattttttatatatatatatatatatatatttatatatatatgtatatatatatatatatatgtgtatatatattgtatagtattgtatatgtatatatatatatgtatatatatatatatatgtatatgtgtatatatatatatatatgtatatatatatatatgtatatatgtatatatatgtatatatatatgtatgtgtgtatatatatatatatgtatatatatatatgtatgtgtgtatatatatatatatgtatatatatatatatatgtgtgtatatatatatgtatgtgtgtatatatatatatatatatatgtatatatatatatgtatatatatatgtatgtatatatgtatatatgtatatatatatatgtatatatatatgtatgtatatatatatgtatatgtgtatatatgtatatatatatatatatatatgtaaggtattatgtagtttttagtatttattggggttttggaatatattttggtggatatatgtgattattgtataagattagttgtatttttttgaggtaaataaatgtgttaatttttttttttttttttttaagatggaattttattttgttttttaagttggggtgtagtggtgtaattttagtttattgtaatttttattttttgggtttaagtaatttttttgttttagttttttaagtagttgggattataggtgtgtgttattatatttgattaatttttgtatttttagtagagatagggtttttttatgttggttaggttagttttgaatttttgattttaagtgattagtttattttagttttttaaagtgttgggattataggtgtgagttattatatttagtttgttttttttttatttattgaagatttagtatttggtgttggtgtttttttttatatagttgttataattttgggtgttttttttatttttttttttatggagtgtttggatgttttttatggaggagatttatgtaggttggatttttagattttagttatttttttagttataatatagttatttttattaaagaaatataagaatattgttttttattattttgagtttttaattttgatataattttagatttgtaaaaatagtttaaagaatttttggttaggtgtagtggtttatatttgtaattttagtattttgggaggttgaggtgggtggattgtttgagatgagtttgggggaaaaaaaaatgtaaaaattagttaggtgtggtgttgtgtgtttatagttttagttatttgggaggttgaggtgagagggttatttgagtttagggaggtagaagttgtagtgagttatgattgtgttattgtattttagtttgggtgatagagtgttattttgtttataaaaaaaaaaaaaatttgtaatttttttatttagatttttttaaagttagtattttattatatttgttttattatttagtttttttttttttttttttttttttgaagaaagtgtgtttaatttgtatatgatgttttaaatttttaattattttaggttatattttttaaaattaaggatattttgttattaatgtttaaggttaagaaatagtattgatatgatattattgtttgatttatttattttatttaaattttattatttgttttattagtgatatatatttggtttaggatttaatttaagattatataatttatttaattgttatgttttttttatttggagatggaattttgttttgtagtttaggttggagtgtaatggtgtgattttagtttattgtaatttttgttttttgggtttaagtaatttttttgttttagttttttgagtagttgggattagaggtatttataattatgtttagttaatttttgtatttttagtagagatggggttttgttaagttggttaggttggttttgaatttttgaatttaattgatttatttgttttagttttttaaagtgttgggattagaggtatgagttattatgtttagttttttttaaaaaataaaattatagattttattttgattttattagtttttttattagtattttttttttgttttaggagttttagtgatttgtttgttttagttttttatttgttttggttttttaaggtattgggattataggtgtgagttatttggatttatttaatttagttttaagtttatattagtatttttgggattgttttttttttatagattttaagttatgtttgagatgatgaattttaagttgtgatttaattatttaagtggtaagtgatatagaggatattattaatttttttttttttttttttgagatggatttttgttttgttatttatgttggagtgtagtggtgtaattttggtttgttgtaagttttgtttttggggtttatgttatttttttgttttagttttttgagtggtgtaattttgatttattgtaagttttgttttttgagtttatgttatttttttgttttagttttttgagtagttaggattataggtgtttattattatgtttgggtaatttttttttttttttttttttttttaaagtagagatggggttttattatgttagttaggatggtttttattttttgattttgtgatttgttttttttggttttttaaagtgttgggattataggtgtgagttattgtatttggtttttttttggtatttaaaaatataattttattgagatataatttatatgttatataattatttattaaaagtgtataatttaatggtttaaattttgtggtatttatggagttggtgtaattgttaatatagtttaattttagaatgttgttattattgttttttagaattttatgttgattagttgtttattattatgatttttttatttttttggttttaggtaattatttattttttgtttttaaatattagaaggtattttttaaaaattgtggtaaaatatatataatatatattttaatatttaagaagttttttaaggttaggtgtagtgggttatgtttgtaattttagtattttgggaggttgaggtgtgtggattattaggttaggtgatttagattgttaggtttttgagtttaagttaagttattatatttttttgtggtttgtatgtatatatttagatggttggtttttgttttaattgatgatattttattatgaaagaaatgaaaatggtttgtttttgttttaagtgatgatattattttatgaaatttttttttttggtttattttggtttaaaagtttttttattgagtattttgtgaattttatttttgtttgttagagaataatttttttttgattgtaatttttttttatttatttaaattttataaaatggttgtatttttatttttttttgttgattttttttttggatttagtttgtttgtatttaggtgaaataaatagttttgttgtttatataaattttgtttggtggtttttttatatggatgtgagtgaaatttggtgttataatttgaattaggggattttttttaggagattaattttttgtttttttgttttttgttttatgagaaagatttatttatgattttttgtttttagattaattagtttaaggaatattttattaattttaaatttagtaagtagtttttttttatttttttttttaattttttttattattttttaattatttttttttttttattttttaatttttttttttttttaattttagtttttttttttttttggtagagataggagatgtgttttatttgtggatttaaaattttagtgttggttatggatttgggaaggtagtttttttttggtgtttaattatgtagggatatttttttgattatttatttatgttttagaggtgtttgattatatggggatgtttgttttggttttttatttttagtggtaagtattgtttttttgggggggtaagaatttttaattttttttttgtgtttttattttttttttgtttttttgggggggtaagaattttttaatttttttttttttatttttagtggtaagtattgtttttttagggggtaagaattttttgattttttatttttgtgttttgatgttttatttttgtattttgattttttatttttatattttgattttttgtttttgtattttaattttttatttttgtgttttgattttttttttg

SEQ ID NO: 93 - DNA, 5619 bp, Artificial Sequence
  chemically treated genomic DNA (Homo sapiens)
aatgtttgttatatgttaaattttataaaatgagtatttgatttttttaaaattttttaatttatttttattaattttattaataatgtttgttttattagtagtatttttttttttttggtttttgttaagtttgtgtttagagttaaggatagaattttatatgtgttattaatatgttgttatttgggataaaatttaataaaaagattaaggttagtgtttatttttgaggagttttattatatagaagtaaagagaggtgattgttattaatatttgggtgatttagagttagatgtatatttggggtagtttatattagttttttaaagtttattatgttttttttttttttttgtttggtttgttggtttgagatagggttttgtattgttttatgggttggagtgtagtggtatgattatggtttagggtagttttgaatttttggggttaagagatttttttatttaagtttttgagtagttgggaagttgggtttataggtatgtgtaattaggttaggttaattgttttatttttttatttttattagagatgaggttttgttatgttgttttagttggttttgaagttttggatttaagtaatttttttattttgattttttaaattgttgggattgtaggtatgagttattatttttggttatagtattttttttttttttgggtgttaatttttttgtgttgtttattttttagtaaagagtaagtgttttttagattttggagtattattttgtattttttaagtgtgggttttatgtagtaatgttttttaaagagtttgaagaaattgagaaaagttatttttattgggtaattaaggttagtattaatgataaatgatatggatagtatattttttgttgttgttttttgagatagagttttatttttgttatttaggttggagtgtaatggtgttatttgttttattgtaatttttgtttattgggtttaagtaatttttttgtgttatttttttgagtttttggaattatagtgttttttattatgtttggttaatttgtgtatttttagtagagttggggttttattatgttggttaggttggttttgattttttgattttaggtgatttgtttgttttagttttttaaagtgttgggattataggtgtgagttattatgtttggttggatagtatatatttttgatatgatgtgatgagaagggagttttatttttgtgggtttttttttgaaaatttagagttttagtttaatgaagggatagtttataatataattaatattttttaaaatagtgaaggttatataaaatatttttaatttgaataaggtataaattttagttaataatgtgttaatattggtttgttggttataataaatgtattatattaatgtaaaatattaataatatggggaaatagggtattgggtatatgggaattttttgtgttatttttgtaatttttttgtaaatttgaaattgttttaaaaattgaagttttttttttgtttttttttttttgagaaaatagattttagggtttttattgtggttatttagatatttatttggtggttattaagtagtatttgttaagaaaaattataaaaagtatttttttttagatttggtttggaaattatttttttggaaatttttttattttatttgataaggaaaataaaagttgattattaatttgggaggggtgtgagtatttgttttttgaaaaatatgattttaattttaatgaatagaaagattatggatattagtgtggattgtttgtagatttttaattgtatttttttaaagtaaaagatgttttttagattgtaattttagaagattggttttttttgttggttaattgtttttatttttagttaagatataaaattattattaatgattatttttgggtatttaagggaagaggatatttaaagttaaagtaaattttttatttaatgtggttagagaggatattgatggaagtgaaaattttattatttgtttaatatagtgtttgtgggaaatattaggttattaagtttttttgataggttttttttatgagttagttagtataagttttttttatatattagatggaggtaagtttagagtgtgtttggaagttattaataggtttgttattgagtttttaataagtattggttgggttgggttgggttgttaaaattaggaagtttggttgggttttttgttttttttaagataatttgttaattagaaatatatagtgaggttgggtgtgtggttgtttttttttttttttttttttttttttaatgaatgtttttgttaaatatgtgaagtgatagataagtattgggtttagtttggggaagtttttagtttttagtaattgagggtagttggaggtatagagtgataaagtttaggtagaaagagtttgtgtttttttgaatttatgttgtagttgttttttattttattttattttattatatttattaggattaagtgtagaagattatttaatatagtttagattaatttttttgtgagtggtaagtgatgggtttagtagtagaatttagggaggaaatgggttggttttataatattaaaggttttaattttttttagtattagatagataattttttttttagttttaatataaagtttttgttaattattgtttataggaggtgatgggagttgtgtggttttattttagtgtttggagggaaggagtggttttttatttttgataattgggtttagttgtattttttttttttttttttttggtaatttttttttgttaattttattttttgtttttttattttttttttttaaaggtatagaaattatgttttttgttttttgatagtttagttttaggtaagaggttagtagatagtatttgttttttagttttgggatttgtttgttattttttgttttgttgagagtgatttttagggagtagttatgagtaattagaaattggtgtttttaaggggtaagagggagttgattgttttttaagggtggtaggggttattgatgttttttttttttggtatttgggtaggggtattttttttttaggttttttaggaagggggatggttggagttaagaggatttttgtgtttagtttttaggtttgagtttttggtgggtttaggggttaggttaggggtagtttttattgatttttgtttggatttaaatatttatagttgaagaggatggagaagttaagtttgttttgggggttgtttttaggtttgtggtttggggtgtttttgttgttgggttggggttgttgtttgggggtgtttatggtgtgtagggtgggaaggttgtggggttgggggtgagggtgggtgtggttggttttgggattttttgtagtggggttggtggaggtggtttgagtggtggggtttttttttttgtagggatgtatgttgggtttggggatggtgtgtttggtgtagtgggttttggatgtgtttggggaagttgagtggtggtggtgatggtggtgtgagttttttgttttggaggtatttgttgtagtttggggaggtggggggggggggggtgtggaggtggggatagggtggttaggttggtgggggtggggttgttattaggggattggaggggaggggtgtgtggtttgggttggttggtgttgggaggaaggaggttgtttgtggatttgattatattgttttgggttattgttgggtgttggggtggttgttgttttttattttttatgggtgagtgtgatatgtgttgtgtgaattagggtttagataagaaagttgttgttattaggatttttgttttaagggatttattggttttatatttttttttgttttttttttttatggggtggaagggggtatttatttttttttattgtagatttgtgtttttaggtgtttttgtgtgtttatgggggtggtatgatttttatagtattttagatatttgtatggttttgaatttaattttttagtgtttaggaaggaattggattgatagtattagttttttttgttatagttatgttttttggttatttattatgtgttaggtgttgggtatttagttggagttagatattgttgtttttggaagtttaggttttggtagtgggagaggtttgaaggagagaaataggataaaaagtatttgtttatggggttaggagagaatttattagggtatgggataaaggttggggtggttttagttttttgggtggttaaggaggatttttttgaggaggtgatatttgaagaaatttgattgatgaggtgattttggggaagtgtgttttggtagtgagaattaaaatatagagttagagtttgaaggggttgggtgtgttggagggagaatgaggagtatagttttgatggggtggttggtaagtgataaatatgtttggttgtttgtttaaagtatgatttttaggtttttttttggagtttttgattttataagtttgaatatagatttgtgaatgtgtatttttaattaagtatttaatgtgagtattaatgaataggtatatttggtaaatattgtataaggatttagtaattaaagaatattttttaataaaattttgttagggggttttattaatttagttgaagttggaaatagatttatagaggtagaaaagattaaaatagtggtttttaattttttttatatattagaattatttgggatatttttttaaatttttgtgttgggttgtaatttaaatttattgaagtagaatttttaatttttttttttttttttttttttttttttggagatggagttttgttttgttgtttaggttggagtgtagtggtgtgattttggtttattgtaagttttgttttttgggtttatgttatttttttgttttagttttttgagtagttgggattataggtgttagttattatgtttggttatttttttgtatttttagtagagatggggttttattgtgttagttaggaaggttttgattttttgattttgtgatttatttgttttggtttttttaagtgttgggattataggtgtgagttattatgtttggtttgaaaatttttttaaattttagatgaatttaaggtgtagttagtgttgaggatgagaagattagatgggagaggttttaagatttttgtgagaattatagtttgattttaagtgatttgaatttttttttatgtgttaggaggaattgaggatatgtattttttaggggagttattttagttttattaaggggatttgtgttaagttatttattattttataaatatttattgagtatttgtttggtattgttataagatgttggggatgtaattattaataagttatagtttttttttttattatgtttatgttttgaaagtaaagtagtatagttatgaatggggtttttaaaattgtatttagattagtggtttttaatttagattatatattagaattatttggagagttgttaaaatttgtatttaatgatttgagtattattagatattga

SEQ ID NO: 94 - DNA, 5619 bp, Artificial Sequence
  chemically treated genomic DNA (Homo sapiens)
ttgatgtttggtggtgtttaggttgttgaatataaattttaatagttttttaggtgattttaatgtgtagtttgggttaagaattattggtttgagtgtaattttgaaaattttgtttataattgtgttattttgtttttagggtataagtatgatgaagggagaggttgtggtttgttgatggttgtatttttaatattttgtggtagtgttaggtaggtgtttaataaatatttgtggaatgatggatggtttggtataaatttttttaatggagttgagatggtttttttgaagaatgtgtgtttttaattttttttggtatatggggaaggatttgaattatttgaggttaagttgtggtttttatgaggattttaagattttttttgtttaatttttttatttttaatattggttgtattttagatttatttgaagtttaaaaaaatttttaggttgggtgtggtggtttatatttgtaattttagtatttggggaggttgaggtgggtggattatgaggttaggagattaagatttttttggttaatatagtgaaattttatttttattaaaaatataaaaaagtagttaggtatggtggttggtgtttgtagttttagttatttgggaggttgaggtaggagaatggtgtgaatttagaaggtagagtttgtaatgagttaagattgtgttattgtattttagtttgggtgatagagtgagattttgtttttaaaaaaaaaaaaaaaaaaaaaaaaaaaaattaggaattttgttttagtgggtttggattgtagtttagtatgggagtttaaaaaggtgttttaggtgattttaatatgtgggaagggttgaagattattgttttgattttttttatttttgtgagtttgtttttaattttagttaagttggtggagttttttggtagagttttattggagggtgttttttagttattgggtttttatgtagtgtttgttaaatgtatttgtttattaatgtttatgttgggtgtttaattaaaaatatatatttatgagtttgtatttagatttatggaattagaagttttagggaggggtttgggaattatgttttaaataagtagttaggtgtgtttgttatttgttaattgttttattagaattgtattttttgttttttttttagtatatttagtttttttgagttttggttttgtgttttggtttttattgttagaatatatttttttaagattgttttattaattaggtttttttaaatgttatttttttagagaggttttttttgattatttaagggattaaagttattttaatttttattttatattttggtgagtttttttttggttttataagtagatgttttttgttttgttttttttttttaggttttttttattattagagtttgagtttttgagggtaatagtgtttggttttggttgggtgtttagtatttggtatgtggtaggtggttaggaggtatagttgtaatgggggggattagtgttgttagtttgatttttttttaggtgttggggagttgagtttagggttatgtaggtgtttgaagtattgtgaaaattatgttgtttttgtgggtatatggagatgtttggagatatgggtttgtaatagaagggggtggatatttttttttattttatggagaagaaaagtaggaaaaagtgtggggttagtgggttttttagggtaaaagttttagtggtggtagtttttttgtttagattttggtttgtgtagtgtgtgttgtatttatttgtggagggtgggagatagtggttgttttagtgtttagtggtggtttgggatagtgtggttaggtttgtggatagtttttttttttttggtattggttagtttaggttgtgtgttttttttttttggttttttggtggtggttttgtttttgttggtttggttgttttgtttttgtttttatgttttttttttttttgtttttttgggttgtaataggtgtttttggagtaggaagtttgtgttgttgttgttgttgttgtttagtttttttgggtgtgtttaggatttgttgtgttaggtgtgttgtttttggatttggtgtgtgtttttatgaggaaagggattttgttgtttgagttgtttttgttagttttattgtgaggggttttagagttagttgtgtttgtttttgtttttggttttgtagtttttttgttttgtgtgttatgaatgtttttgagtggtagttttaatttgatggtggggatgttttaggttatgagtttgggggtagtttttaagatgagtttgatttttttattttttttgattatgagtatttgaatttgaatgaaggttggtggaggttatttttggtttggtttttgagtttgttaggggtttaggtttggggattgggtataggagtttttttggttttagttgtttttttttttaaggggtttggagggagggtgtttttatttaggtgttagggaggggaggtgttagtggtttttgttatttttagggggtggttggtttttttttgttttttaggggtattagtttttggttgtttatgattgttttttgagggttatttttagtaaaataaaaggtggtaggtaggttttaaggttggggggtgggtgttgtttgttggttttttgtttgggattgggttgttaaagggtaagggatatgatttttgtgtttttggagggaggaggtgaggaagtgaagaatggagttagtagggaggagttgttaaaaaaagaaggaaggggggtgtagttgaatttagttattaagggtaggaggttgttttttttttttaggtattgaagtgaggttatgtagtttttattattttttgtgagtagtggttgatggggattttgtgttgaaattgaggaagaggttgtttgtttgatgttggagagggttaaaatttttggtattataaggttggtttattttttttttgggttttgttgttgaatttattatttattatttataagaggattggtttgagttatattaagtgattttttatgtttagttttaatggatgtggtgggatggggtagggtgaggggtagttgtagtatggatttagaaggatataggttttttttgtttgaattttgttattttgtgtttttaattgtttttagttgttgggggttggggatttttttgggttgggtttaatgtttatttgttattttatgtgtttaataggagtatttgttagagggaggaggaggaggagggggaagtggttatatgtttaattttattgtgtatttttggttagtaggttgttttggaaaaaataaaaaatttaattaggttttttgattttgatagtttagtttagtttagttaatgtttgttgaaggtttagtggtaggtttgttagtagtttttagatgtattttgggtttgtttttatttagtgtgtaggaagggtttgtgttgattggtttgtggaggaagtttgttaaggaggtttggtggtttgatgttttttataaatattgtgttaggtagataatgaagtttttgtttttattggtgttttttttggttatgttaggtgaggggtttgttttagttttgggtattttttttttttggatatttagagatggttattagtaataattttgtgttttggttggagatggaaataattagttaatagaagagattagttttttagagttgtaatttggaggatattttttgttttgaaaagatataattaagaatttgtaaatgatttgtattaatatttgtggtttttttgtttattaagattaaagttatgttttttagggaatgaatatttatattttttttagattggtaattagtttttattttttttgttgggtggggtggggggatttttggggaaatagtttttaagttaaatttgaagggaggtattttttatggttttttttggtaagtgttgtttggtggttattagatgggtatttaaatgattataatgaaagttttggaatttgtttttttaaaaaaaaaaaaataaaaaaaaaattttagtttttggaatagttttagatttatagaaaagttgtaaagatagtatagagagtttttatatatttaatattttgtttttttgtgttattaatgttttatattagtatggtgtatttattgtaattaataaattaatattgatatattattaattgaggtttatgttttatttagattgggaatgttttatgtgatttttattgttttgaggagtgttggttgtattgtagattgtttttttattagattagggttttaggtttttgggaggaagtttataaagataaagttttttttttattatattgtattaagagtatgtattatttagttaggtgtggtggtttatgtttgtaattttaatattttgggaggttgaggtgggtggattatttgaggttaggaggttaagattagtttggttaatatggtgaaattttaattttattaaaaatatataaattagttaggtatggtggaaggtattgtaattttagaaatttaggaggatgatgtaggagaattgtttgaatttagtaggtagaagttgtagtgaggtaggtggtattattgtattttagtttgggtgataagagtgagattttgttttaaaaaataataataaaaagtatattatttatgttatttattattaatgttaattttgattatttagtagaggtagttttttttagtttttttaaattttttggaaggtattattatatgaagtttatatttaaggagtatagagtaatattttagaatttggaaagtatttattttttgttgagaagtaggtagtatagaagagttagtatttagaaagagaagggatgttgtggttgggagtggtggtttatgtttgtaattttaataatttgggaagttgaggtgggaagattgtttgagtttagggttttaagattagttggggtaatatagtaagattttatttttaataaaaataaaaaaataaaataattagtttagtttagttgtgtatgtttgtagatttagttttttagttatttggaggtttaggtaggagaattttttaattttaggagtttgaggttgttttgagttgtgattgtgttattgtattttagtttatgggatagtgtgaaattttgttttaaattaataaattagataaaaaaagagaagggatatggtaagttttaagaggttaatgtgaattgttttagatgtgtatttggttttgggttatttagatgttaatagtagttatttttttttgtttttgtatggtgggattttttaggggtgaatattagttttaatttttttattaggttttgttttagatggtaatatattggtgatgtatgtaaagttttatttttaattttgggtatgagtttggtaaaaattaaggaaggaaaggtattgttaatggggtagatattgttgatagaattggtgaaggtaaattagggaattttggggaggttggatgtttattttatggagtttagtatgtagtagatgtt

SEQ ID NO: 95 - DNA, 11143 bp, Artificial Sequence
  chemically treated genomic DNA (Homo sapiens)
tgtaagaattgtagtaaatagaattgtaggaattggaataatatatgaaggattagtattgtttaaaaatttttttttatttttttaaattttttgtttaagagatttttttgttttttttgtttattatgtttttttttgttaattagtttgatttttattaaatgttttgttagtaatatgatttttattaaatgtattattaaaatggattatgtaatgatattatgaatttaaatatttttaagatttaaaaatgtgtaggtagttttattgaataaataatattttataaattattttttatttttgtgtaaaggatagtgtatttgttgaagaaaattagtaatatttgtttgatttttgtttttattaaaaaaaatgggttaatttatattaatttaaaaatattttattgatgaaaaatgtgaattatatgtaagtagtttttttttttttttttttgttagaaaaaaatataatagtttgtatttgttggtaaaattggtttattttgtaaagatggtattgtgttttattttttttggtttattaaagagttaaatatttttgaaattatatttattttatttttatattttttttttttagtttttgtgtgtttattgaaaatattgttgggttttttaataatttttttagaattgttttttaattgtgtttatggagaggtggttatattttgtttttttagtggtttagatatgtagtttgtttagaaagttatagttgttgtggaggaggtaagaggttagtttttttgttggttttggtgagggtaaaatttttaggtaggaggagtattgattggtaaagggaagaggaaagggtttgttttggattttataaatttgttttttggagtaaatagtttgtaggtagaggggtttattagagtttgtttagtttttgggagggttaattttagttagtaagaagatttgaggtgtaggatttttgtgtaggaggttgtaggaatgtttttgttagttgtaaggtttttgttggtttgtagagtttttgtgatttttgttaagatgtgaatagtaaggtttttgtatggattgtagtttttgtttgaaatttgaaaatattaatttgggattttgtagttttggtttttgggtttgttttggaggtgtatttttaatttttatggaatgaattttgtggttaaaatgtatttttttaaggtagtaaaagtgatttttgtatttaataatttttgggttttttttttttttgattattattttttgtagggtgtgttgaaatttttttattgttattgttttttataaatgaaatgatttatttatttgttgtttgtagggaatgaaaggagttgattttgattttaagatgtattttaaagaaagaaaatgtaattgtagtttggattttgtggaggaaggttaattgattttattatgtgtatttttgagttatttgggtttagttagttgtgttaattatgggttttaattttattgtaatttggtattttttggtttgtttttattatagtggttttaaaaagaaatatatataggtatattttagaatgaatttttgggaaggtaaaggtagatttttttggtgtttgagttgatgttttgagagtgtgttgagagttttgggtatgttttggtatttttggaaataaattgtagttaagagtatggtttttttggttttttttttgtttttttgtgtgttgtttggttgtgggatttttggaatatgttgtgtattgtttgagtggttgtggattttattttgatgttttggatagttggggttaggaggagatgagtaggtagttttttgtttttatttagttagttgtgatttttgtggtgtggatttttggttagtagtgaggaggataaggttgtagattttttttgttgtgggttttgggtttggttttgggtggtattttgttttttaaagtgtggaggtgggtagaagagtgtttatttttagtgtagatatttgaggtatgggggtttttttgggggttttagtgtgagttgtttttgtagattagggaaatggagagaataataatggggatatggtggaatttagatttttttttgttaattaataatatgattttgtttagtttaagtgttttttgtgtttttatttaatgttttttgtaaaatgggaattagaataatatttttttggtatggttgttgtgtttgatgtgagtttttaataaatggtaggatgaattggagaagaatgggtttattattttttatatttttttttgtagagtttttttgttgtttttagtttttttgttttgatgtaaggatagtttataattagtgtttttgagtagtttttgggggttgtaagagaatttgtttggtagggtatagaagatgggtttttggtgaattgtgaaaagatatgattgggttttttttggagtatggtggagaatgatgtggagttttggggttaatggagagttgagggtgtagagggatttgaaagggggaattaaaaatattgggttttgaaattttgtggatttttaaaggtggtttttaattttgttaaaaattatagtgggtgtgtgatttaatttggtttttataggtggtgttgtgataaggtgtggtggttgggagaggtggttgggggatttgaagattgtgggaaattttttgtgattttgatgttaatttgttgtttttagtttttgttttttgtttttgagggattagttaggattgtgtaatattagtttttgtttttggagttggtatgggggttggtgggtggtgggatgaatttggggaaggtgataggttggaaatgtagttttttgattttgtagtgtattaattttttattgttttgtttgttgtttaggtgtgaggatttgttagatgttataggattgggggtgatttgtaagggtattatgttatttagaggaaatgtgtagtgagtgagttttgggttattgaaaatgggagaatgtttgagttggttaagatgattttggtttgtgagttgatttagattttttggaagttagaaattgggtttagagtgggttggtttttttgttagtagtttgggtttagttgaagtttggggtttagagggtagatgtttggttttgattagagtatagtgggttgggtttggtagtttgtaggtaatttggattttgtaataaagttgtatttaatataatttagattatagtgggagtttttgaagggttttatgtgagttttgaaattagagtttagaggtgtggtttggtttttgtttattttttttagatagtatttaggttaataaggtttttgaaaggaggtagttttaaagtttttaggttgatatttgagggtagggttttaaatagttgtgtttgaagaattggtaattttgttttttttatatgtagttgtattttttttgagtgttgtagttgatggttgtatagtgattatggattgtgttttttttatgaagttgtgtaatttttgttaatgttgtaattttggtaagatgaaatttttttttttttggttagattagtttagtttttttttagggatttttttgtttttttttatttttttttatttttaggttgtttttttttttttttgttgggatttgatttttgtttgtttttgtaattttgtagtttggagttttgttttgtgtattaaaatatgtttttttttatttgtagatttaataaataaatgtaattatattatatggagttttatattgtttttttgaaagtaattttgttgttgaaaattgaaaaatgggtgtaatttgtttttagaaagtaatgttagggttatggtaattttttgggttgttatttatttttattttaaagtttttaggaaagatttgtttatatgtttggaaaatttttaaatgtgtgaatattagtaattttgtttgtttttaatgtgtggggtaagggggggtggggaataattattgagtgatgttaatatggggaaattgaaaagaaatgttgattgtttttattgtaatagaaggagtgagtaaatagaaaaattaattttgggtgattggaaataggtaggtggagaattaaaagtgggttttagatagtaataggttttttttttgtttttgtaaggagaaagtgggtgatgagtgtttgtagtttgtggggttgattttattttttgtagggttttggttgtgttgttgttggattgtagaatgttgggatgtatttttgagtttgggtttgatttaatttgttgttattttagttatttagtggagttgtggagagatttttgaattgtgaggttttttgatgagaaggtggagaggttgttgggttattttttgagtattttttggttgagttttgtttttttttgtgtgtttgtggtttttttttgggttagtgtgtttgtagtttttttaagtttaggttgtaggttagtgtgtgggtgttttttgttttttttttttattagaggatttttgagggttgtttttatttttaatttttgtgattgttttttttagttgttatttttttttgtagtgtagattttgtaggggttagtggtttagggtggatttttttttgttttgggtgtggggtgagtttttggttgttatttgttgttgtagttttagggaaatttagttggttgtttattttgtaagatggggatatagtagagggttgagttttggagaagttgggtttgtttttttttttgtattgtgtgtaatgttttaattgattttgaagggttttgtttttattgtatttgtttttagatggttagaagttaatgtattatgaaaattttagttttggattttggattttggttgttttataatttttgtaatttttttgagtggataagaggtgggtattgttgtttgggttttgtttggggggggggggttttgtttttagtagggggtaagttggaggaattagttttttaatattttttgttagttttgtttgttataattgtaatttggaatagaataattttttttttgtgtatatgtatttttaatttttgttttatttttttatttatagttattattgatttgtagatttggaggagtaggtttttgggggttggtttaggttggggatatagggaggggtttttgtgttttgtataatttgtagtgtttgggtttgattttggtagtttttgggtatagtttgttgggttagatttttgttgtttttttgtgtttttttgtgggttgttttagtgttgggaagggggtgttgtaggtgattgtttgtggtattgggatggttgatagatttatggagattttatagtatttggttggggtttgtgagggtagggtggagtttggttgatttgatgttggggtttaaagtttttttagttatatgtttgggttgagttgtttttagagtttttggtttttgttttttttgggtgggtgtatataaggatttggttagtgttgagtgtattggttttttttatttagtgtagtttttttttttatatttttggtttggtttttagttttttattgagtaaatatttatttagagagtgagttgttttttggaggaggttttgatgtggttagggaaaggttttttggtttttttttggtttgagttagttgtaggttttattggtgttttggttttggttttaaatttttttttttagttgaaatttttttgatttttttgagattttttgagtttagagtgagtagtgtaattaggtggtagattttagttgatttttgtttttgttttaggttttgtatttttatatttattgggattgattagattttagtgttttttttttttttttttttattttttttttttgttttagatttgttgttttttggttggttttagtgggttgttgattattttgttttagtatttggtttgtgttttgggaaggttttagtattatttttttttgttgggattttgttgattttgtttgtagttttggttttttttgtttttagagtggggtttttggtttgttgtggatatttagtggtttaaaatatttaaaattgattttttttgtgtttttgagaatgttaagagtatttagtatttgtaattgttggtatgagtggggtttgtggggagttgttagagttgtggataggttttttgtttattgagttgttatttttggtatgtttaggggatttgtagtagttgaggttatatggttatagttaagtttagtaggtggaaagggagagatggtattgaatttatgtgagaattgggaagatgtgtggtagttgaaggagttggtaggaataagagggagttgtatgttatttttatataattagagttttaaattatattagtttttgaattagtttaggttggtgttgtagaattgttaaagtttttgtagagtttttagattttttgtgggatatgaggttttgtttgtttgtatgtgaatatttttgtatttgtttagtagttttgtagattgtaaattttttttgggtgtatggaagtagagtagatttggtgtagaggttgatatttattgtttgtttgtgaggggggaggaggatttttttttggttaagttgttgggtatgtttatttttttttgtaagtttaaggtagagttataagtttttttatgatgtggtaaagttttaattaatttatttattagttttaagaaggagttgttgtttttaaaatttttagatttttgaaggttttttttgtgtaaaaatgttaggtggtgttatatgatgttatttaataggtattggaggttagattaggttgaaattgttattaagttaaattttaagaagattttaaatatttgaaattaattaataaaaagggataagtttaagtatgtttagttgtgggattttttttaagattttgattttaaagagtggtgttttagtttatttttattttttatattttttattttgttaggtaattttgaatttagagtgtattttaattatagaagtgggaatttggagatttgtttttttgtagaagtatggttgattatagtttttttttgggtttttgtaatttattgatttgagatttgggattagttagtttttttgggtgtagattgtagttatatatatttttggggattgttggggaagtagtttgaattttgtgtgtataaggagttttttggattgttaagtagtagtaatagagtttatgattttaagtagtataaatttttaaatttatgaaaatatttttttttttgtttattattttgatttatattttttataattttaattgtaaatattaataattttggttgtaaaaaagtatatggtatattttagattagatttatagtgaataaaagtgaaaatttagaagtaggtagaatgatagggtttttggagtttaatggaagatgagggaattatatttatgtgtagtgttggtgtttattgttttgggattaagttttttttatatttaaataaaatttttttgagagggtttgttggtttggagaatttttataaatgttgttattgagggttaggggtttaggatagtggttgaatgtggtagagttttgggttttgtagtgagtgttttatgtattggtaattggttgatttggggttgtgtgttagtgttagttgtttgtggtttagttttttgtatatggtgtggtttgtgttttgagtttgtgtggttagtggttggttggtttatttggattggggggttgttgtaggaagttggtggtaggaggaatttttttggttttaatagtggtttttatttgtggtttgggttttttgtaattttttggtttttttggttggtttatttttttatatttgtgtttttgttatttggtatggattgaagtgaggtagaattggtaggtgatatagatttttttttgatagtttttagaggtttgtatgatagattttgttaagataatttttttatttttgtgtatggtggtgtttgttttttatttatagttttaattttaattttgagatgtttattgttttttggaggaggtttttttgggttttttttttttttgagttatttatatttagattaaatgtttttatttgtttatttagtattttattagtttgattttgttgtttttttgtgttgtttttgggaagatgttaaatatttatttttattgtatttagttatttaggtggggagttagtttgaaagagatagtggaaggagttttttggattgtgttgttgtttattgatttgtattaattattatgtagtttgtttttggatttgttttttttagggtgtgtttttagtgagtgatagatggagttgttttgttttgtttagtttagtttatgttgttgtttagattgaaatgtagaatttaagttttttttattggggtatagatttttttttattttttttttttgtttttttgttttttttttttgggaagaagtggaggtgttggtggttggttgggatagtaataggttgggttattgaggtggtgtggaaagtttttgtttgggagtgtggaattggggttgggttggtgtattgtttggagtaatgggtgagtggtggtgggggattttgttagagttgggaagggagggagggagtgagtgggtaagggagggagggagggagggagtgtgagggtgtgtgttattaggtgtttatattttttattgattttgtttgtgtttttataagttgtaggaatatgttaagggttagtggtgtatagtagtttaatgtgaatgttggttattgggtggttgttgatgttattttttgattttaagagaagggagttgtggtattagtgagttttttagtttgagtagtaaattaagttttgttttatatgtgtgtatatatgtaaataaaataggaaaagaaaagaaaagaaaataaataataataaataaaatattttttagttttttttagattttgtttaattggttgggtttttagaaggaatgttggggatgggatgggtggagagagggagtggtttaaggattttagtgaggagtaggtgagaaggagtatgtttaggtgttaagattgatttttttttttgttttgggagatttttgaatgtttggagaggtttggtattttattattttatttggttgtaggggtttttggtatggtaggaatgagggagggggtttgattggatagtgatggtttggggttgtttggttatgtttagggattatatggtttggggatagttttagtagttagtaggggatgggtgtgtttgtttagtttttggatgtgtagggaggtttagtggtaggtagttgttttaagtagtgggtgtgtgtttttgtgtgttgtgtgtttattttgtagagttagtttttggggaggtgaattagttgggaggagtgtttgtgaatgggaggttgttgtttaatgttatttggttttgtattgtggaattggtttaattgggtatttgattgtgtgatattagttgttagttatgggttttgtatggttgtgttagtaagattttggtgtgatataatgagatgggtttgattttgttaggagttattgggggtagtaagttttgggttattatttttattgtggtgaaatatatttggatttataagtagagagattttggtatttttgtttgggagatttgggattgtttgttggtggatggtgtgtgtgataagtataatgtgttttttgtgagttttattagttgtattttgtgtaataagattggtaatttggtttagtagggttattatgatttatataagtagtattagttgatgttgtagttagtgttgttttataattatatttatttgtattttagttttattatggtggtggttgttaaggtgtttatgttatttggggtgtttgttatttttggtttggtggttatgttgtgtatttggttttttttgtattttgttattgatattttgggtatttgttttattattgattaaggtaggggtttagaggttgggtgtgtggatgtgtagtgtttgtttttgtatttttgtggaggttttagtatttgtagttttagggatattgttttttttattatttgaggtttttttttttggaaatgtaaggagtttttttagggggtgttttgattttattaatttgaaatttatgtttttggtttttttgttatatatagttttttgttttattttaaattattagatttataatatttttttatttttaatatatggtttgtattttttatttttttttgttttttgtgttgaggtagttttagtttggtttgtttatttggagagtgtggttggggttggatttggggtgtagtttgggaggtttgagtttgtttggggttgttggttgtagattttgttgtgggtagagtagtttgtttggggattattatggttgggagaagtttggttgggaggagtttagtatgttttggaaattgaagtattttttgattttggtaattaggttaaatttgtttaggtaggaagtttaaatgttatttaattggttttgtttttatgttttattttattttttttggaaatggaggttttgaagttattattagtaatttgtatgtaatttatttttagatgaagttatatttatattttttttttttttttttttttttttatttattttttaatttaatagattttattgtatatattttaggaagggaagtggtattagttattgtagtgatggagataaaatgtaggtaattttatgttgtttttttattgttttttttagttttttttgagtttgttatttttttttggggtttttgggtttttgggtttttgagaatgtaagtggatatttatttagtttttgtatgttttaagtagtgttattttattgtttttttttttttttatttttgattttgtttagttttaagtgttttttttgttttgttagaaggattttttgagtttttttgtttagtttggtttttgta

SEQ ID NO: 96 - DNA, 11143 bp, Artificial Sequence
  chemically treated genomic DNA (Homo sapiens)
tgtggaagttggattgggtaggagggtttggggaatttttttgataaggtagaaaggatgtttaggattaggtaaggttaggggtgagaaaggaaagaaatagtggggtggtattgtttaaaatatgtaggaattagatagatatttatttgtatttttggggatttggggatttggggattttaaaggaaagtggtaggtttagggaaaattgaaaagaatagtaaaaggatagtatggaattgtttgtattttatttttattattgtagtggttgatgttatttttttttttaagatatatatagtgaagtttgttaagttagaaagtgaatggagagagaaagagagagagagagaatgtgaatatgattttgtttgggaatgagttatatgtaagttattagtagtaattttgggatttttatttttgaggaaaatgaagtgaagtataagaatgaaattaattaggtgatatttgaattttttgtttgagtaaatttggtttgattattagaattggagaatattttaatttttaaggtgtgttggattttttttggttagattttttttggttgtagtgatttttaagtaagttgttttgtttatagtggagtttgtagttggtagttttaagtaggtttgggttttttgggttgtgttttaagtttagttttggttgtattttttaagtgagtaagttgggttgaggttgttttggtgtgagaggtgggggagggtggaaaatgtgaattatgtgttggggatggggggatgttatgggtttggtagtttgagatgaggtagaagattgtgtgtggtaaggaaattaggggtatgagttttaagttaatgagattagaatattttttaggaagattttttatgtttttaaaggaaaaagttttaggtggtgggaaagatagtgtttttgaggttgtagatattgggatttttgtgagagtgtgggggtagatgttgtatatttatatgtttagtttttgagtttttattttggttggtgatggagtggatgtttaggatgttggtgatggagtgtgaggagggttaggtgtgtggtatggttattgaattggggatggtaggtattttgggtggtgtgggtattttggtggttgttgttgtgatagggttggggtatgagtagatgtggttgtagggtagtgttggttgtggtgttggttggtgttgtttgtatgagttgtaatgattttgttgggttaagttgttgattttgttgtgtagaatgtggttgatggagtttatggagggtatattgtatttgttgtatatgttgtttgttagtaggtggttttggattttttaggtgaagatgttggggtttttttgtttgtaggtttggatgtgttttattatggtgggggtagtgatttggggtttgttgtttttgatggtttttggtaagattgagtttgttttgttgtattgtgttaggattttgttgatgtagttgtgtgagatttgtagttggtggttgatgttatatggttggatgtttagttgggttagttttatgatgtgaagttggatggtgttgggtagtggttttttgtttatgaatattttttttagttggtttatttttttgaaggttggttttgtaaaatgaatatatagtgtgtagggatgtgtatttgttgtttgggatagttgtttgttattgggtttttttatgtatttggggattgggtgaatgtatttgttttttattaattattggggttgtttttaaattatatggtttttgaatatagttgaatggttttaaattgttattgtttaattggatttttttttttatttttgttgtgttggaggtttttatggttaagtaaagtggtgagatgttgggtttttttgagtgtttaaaagttttttgaagtagggggagaaattggttttgatgtttgaatgtgtttttttttgtttgttttttattaaagtttttgagttgttttttttttttatttattttatttttagtgttttttttggagatttggttagttaaataaagtttaggggaagttagagggtgttttatttgttgttgtttgttttttttttttttttttttttgttttgtttgtatgtgtgtgtgtgtgtgaaataaaatttggtttgttatttgggttgaggggtttgttgatgttatagttttttttttttaaaattagaaaatggtattaatagttatttagtagttagtgtttatattgaattgttgtgtgttgttgatttttagtgtgtttttataatttgtaggaatatgagtaaagttaatagagaatgtgagtgtttagtggtgtgtgtttttgtgtttttttttttttttttttttttgtttgtttgttttttttttttttttttggttttgatagagttttttgttgttatttatttattgttttgagtagtatattaatttggttttagttttgtatttttagatagaaattttttgtattgttttagtggtttggtttgttgttattttggttgattgttggtgtttttgtttttttttaggaggaggaggtgagagggtaaaaggaagaagtaaaaggaagtttgtgttttgatgaaagaggtttgagttttgtattttaatttaagtagtaatgtgggttgggttgagtagggtagggtggttttgtttattatttattggggatatgttttaaaaggggtgggtttgagggtaagttgtatggtgattggtgtgggttggtgagtgatagtgtagtttaggaaattttttttgttgttttttttaggttagttttttatttgggtgattaaatataatgaaaatgggtgtttgatatttttttagaagtggtataaaaagatagtaaaattaggttggtaaaatgttgaataaataaatgaaagtgtttggtttgaatgtgaatgatttgaagggagaaggggtttgaggagattttttttggggaatgatggatattttagaattgaagttaaggttataggtgggaggtgggtgttattgtgtataggggtgagggagttgttttagtaaaatttgttatgtgggtttttggggattgttaggagaggatttgtgttatttgttgattttattttattttagtttatgttaggtggtgagagtgtaggtgtgagaagataggttggttaaagaaattaggaggttgtggggagtttgagttataggtgggggttattgttaaggttagggaggttttttttattgttagttttttgtggtgattttttagtttaggtggattggttaattattagttatataggtttgaggtatgggttatgttgtgtgtggggaattgaattataggtggttaatgttagtgtatagttttaagttgattaattgttagtgtgtggggtatttattatggagtttaaggttttgttatatttagttattgttttgggtttttggtttttggtggtagtgtttgtgagggttttttaaattagtgagtttttttgaaagagttttgtttaaatatgaaagagatttagttttaagatagtggatattgatgttgtatatggatgtaatttttttgttttttattaagttttagaggttttgttgttttgtttatttttgaatttttatttttatttattgtaagtttaatttaaagtgtattgtatgtttttttgtagttaaagttattaatatttgtagttagggttgtggagaatgtgaattaaaataataaataagaagagaaatatttttgtgaatttgggagtttgtattgtttggggttgtgaattttgttattgttatttgataatttagaaggttttttgtgtatataggatttaggttgtttttttaatagtttttagggatgtgtgtggttgtggtttatatttagagaagttgattggttttagattttaggttagtaagttgtaagaatttaggaaaaaattatgattagttatgtttttgtaaaggaatagatttttagatttttatttttatggttaggatgtattttaaatttaaaattatttaatagaatggaggatgtgaaaggtaaagatgaattaaaatattattttttagaattggaattttgggggaaattttataattagatatatttgaatttgtttttttttgttggttggttttaaatgtttaaaatttttttgaagtttgatttgatagtaattttagtttggtttgatttttaatatttgttgggtgatattgtgtggtattgtttggtatttttatataaggagagtttttggaaatttaaagattttagaagtagtagtttttttttaaggttggtagataaattagttgagattttgttgtattgtaggggagtttatgattttgttttaggtttgtgggagggaatgaatatgtttggtaatttgattaggaaggaatttttttttttttttatagataggtagtgagtattgatttttgtgttaaatttgttttatttttgtgtatttagggaaaatttgtagtttgtagggttgttaggtgggtataaggatgtttgtatatgaataggtaagattttatgttttgtggggggtttggggattttgtgagagttttagtagttttgtagtattagtttagattggtttagaaattgatatggtttagagttttggttatatggaggtaatatataatttttttttgtttttattaatttttttagttgttatatatttttttagtttttatataggtttaatgttatttttttttttttatttgttgaatttggttgtgattatgtggttttagttgttgtggattttttgggtgtgttaggggtagtaatttagtgggtagggggtttgtttgtagttttggtggttttttgtaggttttatttatgttggtggttgtaggtattgggtgtttttggtatttttaagagtgtaggaagagttaattttaggtgttttgggttattaagtatttgtggtaagttgaagattttgttttgggagtaagagaagttgaagttgtagatagggttagtgggattttagtagaagagggtgatgttgaagtttttttggggtgtggattgagtgttagggtgaggtagttagtgatttgttgagattgattgagagatgatggatttgaggtagagaaagaggatgaaggaaggaaaagagagaatattaaggtttggttagttttgatgaatgtaaggatgtaggatttagaataagaataagggttagttggagtttgttgtttggttatattgtttattttggatttagaagattttaaagagattggaagaattttgattaaaaggagaaatttaagattaaaattaaaatattagtaaggtttgtagttggtttaggttagggagaagttaaaaagtttttttttagttgtgttgaggttttttttgaggggtgatttgttttttggataaatatttatttagtgggagattggaagttgggttgagagtgtgaaggagggggttatattgggtgggaggaattagtatatttggtgttggttggatttttgtgtatatttgtttaaggggagtaggggttggggattttgggggtgatttggtttaggtgtgtggttggggaagttttagattttagtattggattgattggattttgttttgtttttgtggattttagttagatgttgtgaagtttttataaatttgttagttgttttagtgttgtgggtagttatttgtggtgttttttttttggtgttagagtggtttgtggagagatgtggagaagtaatgggaatttagtttggtagattgtatttgagggttgttgaagttagatttaagtattataggttgtgtggaatgtgaggatttttttttgtatttttaatttggattgatttttggaagtttgtttttttgggtttataggttagtgatgattgtggatgggaggatagggtgagagttgggggtgtgtatgtatgggagagaggttgttttattttgagttgtagttatgataagtagagttagtagaaaatattaaggagttgatttttttaatttgttttttgttggggataggattttttttttttaagtgaggtttaggtgatggtgtttgttttttgtttatttggaggagttgtagggattgtaagatagttagagtttgaggtttgggattgggatttttatagtgtattgatttttagttgtttgggggtaaatgtagtaaaggtaagattttttagggttagttggggtattgtgtgtggtgtagagagaaaaataagtttagtttttttagaatttggttttttgttatgtttttgttttgtagggtaagtggttagttgagtttttttgaaattgtagtggtaagtgatagttagaagtttgttttgtgtttagggtgagggagggtttgttttggattgttggtttttgtaggatttgtgttgtgggaggggatggtggttaaaaggagtagttgtggggattggggatggagatagtttttaggggttttttggtgggagaggaggataggaggtgtttgtatattgatttgtggtttggatttggagggattgtggatgtgttagtttaaggagaagttgtaagtgtatggagaggagtagagtttggttggaagatgtttggagaatagtttggtagtttttttatttttttattaaggagttttatggtttaagagtttttttgtggttttattaggtagttagaatggtagtgggttgggttgggtttgagtttggaaatgtgttttggtgttttgtggtttgatagtgatatgattggagttttgtgggaggtgggattagttttatgggttgtgagtgtttgttgtttgttttttttttgtgagagtaggggaggggtttgttgttgtttgaaatttgtttttaattttttgtttgtttgtttttgattatttggggttggtttttttgtttgtttattttttttattataataaaaataattgatatttttttttagtttttttatattagtgttatttagtaattgttttttatttttttttattttatgtgttgaaggtgagtgggattgttggtatttgtgtatttggaagttttttgagtatataagtaaattttttttaaagattttaaagtaaaaataaataatggtttgagaaattgttgtgattttaatattattttttgaaagtaaattatatttattttttagtttttaatagtggaattgtttttagaaggatagtgtggagttttatgtgatatggttatgtttgtttattaaatttgtaaatgaaagagaatatgttttaatgtatggggtaaaattttgggttgtgggattgtaagagtgaataaggattggattttaatagaggaaggggggagtggtttaggggtagggaggggtagggaggggtaggaaggtttttgaggggaggttgggttgatttagttagagggagggggattttgttttgttagggttgtagtattagtagaagttgtgtagttttgtgaggaggatgtagtttgtggttattatatagttattagttgtagtgtttaggagaggtgtagttgtgtgtgggaaaagtaagattgttggttttttaagtatagttgtttgagattttgtttttaggtgttggtttgagggttttggggttgtttttttttaaagattttattggtttaaatgttgtttggaaaagataaatgagaattaggttgtgtttttaaattttggttttgggatttatatgaagttttttgggggtttttattgtggtttgagttatgttgaatgtagttttattgtaaggtttaggttgtttgtaggttgttaggtttagtttgttgtattttgattagagttggatgtttgttttttaggttttaagttttggttgggtttgaattgttgatggagggattaatttattttagatttaatttttggtttttgaggagtttgaattaatttgtaggttggagttattttgattgatttgaatgtttttttatttttagtgatttagggtttatttattgtgtgttttttttaggtggtatgatgtttttgtgagttgtttttagttttgtggtgtttggtgaatttttgtatttgagtagtggatggggtgatagggggttggtgtgttgtaaagttgaggagttgtgtttttagtttgttgttttttttgagtttattttgttatttattagtttttgtgttgattttgagagtggagattggtgttgtatagttttagttaattttttgaaaataggaagtggaggttgggagtagtgggttagtgttggagttgtagaaaattttttgtagtttttgagttttttagttgttttttttggttattgtattttgttatagtgttatttataggagttagattagattgtgtatttattgtagtttttgataaggttgggaattgtttttgaaaatttatagaattttaaagtttgatatttttggtttttttttttagatttttttgtatttttaattttttattgattttaaggttttgtattattttttattatgttttaagggaaatttgattatgtttttttatgatttattgaaaatttattttttatgttttattgggtggatttttttgtggtttttaggggttatttaaggatattggttgtgagttgtttttgtgttagggtgggagagttggagatagtaaagaagttttgtagggaagggtgtggggagtgatggatttatttttttttagtttattttattatttgttgagggtttatgttaaatataataattatattaaggaggtattattttagtttttattttataagagatattaaataagaatatagaagatatttggattaagtgaaattatattgttaattaatagggggaaatttgaattttattatgtttttattgttgttttttttatttttttaatttgtaggagtagtttatgttggagtttttaaagaagtttttatattttaggtgtttatattgaaagtggatatttttttatttatttttatattttagaagatagaatgttgtttaaggttggatttagaatttgtagtaaagaggatttgtaattttgttttttttattgttggttaagagtttatgttgtggaggttgtagttgattaggtgagggtgggagattgtttgtttgtttttttttggttttggttatttagggtgttgaggtgaggtttgtagttatttgggtggtgtataatatgttttaggagttttgtggttgagtggtgtatagaggagtaaggagaggattggaagaattgtgtttttggttgtaatttgtttttaagagtgttaagatatgtttgagatttttagtgtgtttttagagtattaatttaagtattgaaaaaatttatttttgtttttttggggatttattttggggtatgtttgtgtgtgtttttttttaagattattatagtgggaataaattaggaggtgttgagttgtaataaaattagaatttataattaatatagttagttgggtttaagtggtttggaagtgtatgtagtggagttagttggtttttttttgtggagtttgggttatagttgtgttttttttttttggaatgtattttggagttaggattaattttttttattttttgtaaatagtgaataaataaattattttatttataaaaaatgataatgataaagagattttagtgtattttgtgagaggtggtagttaggagaagagaaagtttaaaggttgttaggtgtaggggttatttttattgttttgggaaaatgtattttagttgtggaatttgttttgtggggattgggggtgtgtttttgaggtgggtttgagggttagaattgtgaaattttaagttagtgtttttaggttttggataaaaattgtgatttatatgaggattttattgtttgtattttggtggggattatgaaagttttataggttagtaggaattttgtggttagtgggggtatttttgtaattttttgtgtagggattttatgttttaggtttttttattggttggggttggtttttttgggaattgggtaggttttaataggtttttttatttgtaggttgtttgttttaagaggtggatttgtggggtttagggtgaattttttttttttttttttgttagttagtgttttttttgtttaaaaattttatttttattaggattaatgaaagagttgattttttattttttttatagtggttgtggttttttagataagttgtgtgtttgagttattgggagaatagagtataattatttttttatggatatgattggaaggtagttttaggaaaattgttaaaggatttaataatgtttttaatggatatatagaggttaaggaagagaaatgtaaaaatgaaataaatataattttaaaagtgtttaattttttaataagttaggaggggtaaaatatagtattatttttgtagagtaaattaattttgttagtaggtataaattgttgtgtttttttttaatgagagagggggggaaaaggttgtttgtatatgatttatattttttattaataaaatgtttttaaattaatatgaattagtttattttttttggtgggggtgggaattaagtaagtgttgttggttttttttaatagatgtattgttttttgtatagaggtaaaaaataatttgtaaagtgttgtttatttagtgaagttatttatatatttttaaattttaaagatgtttaagtttataatgttattgtgtaatttattttggtagtgtatttaataaaaattatattattggtaggatatttaataaaaattagattaattagtaaggaagggtatagtagataaaaaggataaagaaattttttgagtagaaaatttagaaaaataaagaagggtttttagataatattaattttttgtgtattgttttaatttttatagttttgtttattgtagtttttatg

SEQ ID NO: 97 - DNA, 9498 bp, Artificial Sequence
  chemically treated genomic DNA (Homo sapiens)
tatgtatgtgtagataaattgggttttaggaggatgatttggtttatttttatttttatatgttttttttttaagttgaggaagaagagaggaatatgtatttaatgatattaatgtgttaggtattgtgttatgtgtttattttagtgtattttttataataattaatgggaaataaatgattatttttattttatagatggggatattgtagtatagagaagttgagaatattttgtggttttagttagtaagaggtagaggtgtattttgaatttgaggttagggtttgagtgttatggtattaggttgtgagggagtttattgagtattaattttgtggtttaatgtttttttttttattttaattttgaatgtttttattagaatttaaggaggtagatagtagtgtaattttatttaagagttgttgaaattgaggtttagagggttttagtgaaagggttgtgtttggttttaggtatttgggttgagttttttttttattattgtagggtgggaattagtggagggggttggtttggatggggagaaaagtaattggagggtgttgaggggaagagggagtttggatttgttagggtgtttttttggattaagggatgtttttttaaattatattattttattttgtttagattttgggaaatttggtatgtatatattttgtataataataggtagggtgaggtttttaagttttgaagattgtttttttagtggaggtagtggttttgatgagggggtatagttgtatgtgtggggtttttttttgaattggagtgtagtgtagttgaggtttaggattttttatttattatttatgatgtttattagagtggggtaagggagaggaaagaagagggaagtagagagaaaaagaggttaggggaggtggaggtgggtagtgttaattttgagagtttttaagttttgaaattttgagaaggaagattaagaggttaaggtgtttgggaagtagtaggttgttagtaaatatttgtaagatggatggataattgggtgagtgagtgaatgggttaattattagtttttttgatttttgttttttttatttgtaaaatgggataatattatttattttatatggtgggtatgagaattttatgggtaaattttaaattgtttagtatatattaggaatttttaaatggtagttgttgttatgaggaatgggtttgtaagttttggttgtttagtagaaatgtattgaaggatttttaggtttggagggttattttgaatagttgttattttaaaaaaaatattttataagtttttttagatgggagggttggaggaagagtgggttaagttatattttttaaatgaaagaaagaaaggtaagtgtggggaggaagttattttggattgagaaggtagttattgtttttatttttattttggagtgtggttgagggaggtggggtaggggttatttgggttttgttttggtagttttttattttttttagggtttgtttgggtgtttggaggtgtttttttgttgtgttgtgggattggattttggtggatagtttgggtgtgaggttaggagtgttttggaaatgggtagtttggtggtagttgggttgatggagtgtgtgtgtgtgtgtgtgtgtgtgtgtgtgtgtgtgtgtgtggtggagaggggaagttggagtagggttaattttttgttttagtttagtttagggttatttttttatttaggtagtttgagttgggataggatggagaggttgggatttttggggtggtatgggggaagggaagtttatgaagaagaaagaattggaaaggtttggtgggttggagttagtggggtggggtggattgggagaggttaggttaggtttgggtataaaggttgtggagggggtggttgttgtgggtgtagaaaggtgtgttgttagttgttgtttttttttattttttgggttgtttttgtgagtttttggtgtgtgagtatgtttgtgtgtgtttgggttttttttggtaggttgtttgtaagatgagtgaagaagtaggtgggggagaggggaggtagtgagtgagagggtgaggggagtgtgggtgttgagtagtgtttatttggagagtggtaagtaagttagataagtttgattttatgttatttgttgttattttgttaggagtgtgaagatgatggttatgaattttaagtagttttttggtatgtatttggtgttgtaagaatttaaattttttagtttgtattttggttttgaggttatgtgttgagtttgttttttagttttgtaggtatgtagtggagtataattattgttttaaggtatattttttgataggtattagttttatgttttttttatgttgtttagaataattgttgttgtttgaatttttttttttgttttttttgtgtttttttttggtgtgtttttttttttatttatgtttttgatttatatgtttgttttagtagagttgttgtttttgtattaatttttatgatttgggttttgaggagaggtattttggttgtttgaaaatgtgttttaattttgtgttgatagtattttttattgattgtgttgtgtgtttttttgtttgtagttgtagggtaatatatttggaagttttgatgagagtttgttggtatgtgttgaagttttggtggtggtggatattgttttttatggtaagaattatttgtttaagtttgatgttatttattatattatgagtagtgtgttttgtatgtttattttgtttattgtgtttattttttatttagttgtgtttattttatatttttattatgttgtgtattagggttttgaaggtgatttgttggagtatattttgtttatgttgagtgtgagtggtttgggtgttttggaatatttggtgatgtttgtatagatttatttatattatttgggtgttatgggttatttgtattaggttatgggtatgagttatttgtatattgtggttttttatagtgttatgtttgtatgttttagtgatgtggagttagatttgtgtgagttggaagtttttgttgagtgttttaagtagtggtgtattaagttgggggtgatttaggtggatgtgggtgtggttttggttaattttaagatttttggtgtgggtttgttgagttaaagtattatttgtaggtttgagttttttatttttttgtataataatatgattgtttttaagttggtgttttaggtttggttggaggaggttgaggttgtttattgagagaagaatagtaagttagagttttttaatggtagtgaatggaagtgtaaatgtatgtttattgtggtgttggagaagtgtttatttgaggtttattttgttatttagttatgttttttatttgagaagattgtggttattgttgagaaattggattttaaaaagaatgtggtgagagtttggttttgtaattagagatagaaatagaaatgaatgaagtatttggttgtttattgattgtggtagggtgtagtgttgggagttgggagagtttagtgtttattttttttgggtttgggggatggttattgggaattttaaggtgttttttaggtaggttaggtttttttttttgaagttatagattttttttttttgttttgtttggttgtttttggtttttttttttttttttttttatttttattaaaaaaattttggtgttgggaaaatattgtagaagggtgggtttgagtgtatttgtgttgtttgtggtgttgaaatttgtttttgtgtaggggttgtatgattttagagtaggagttttaaagtagaggatagttaattggtttaattgtttgaagttagggtgaaaatgttattttgttaagtgtgattaggtaaagggtgaagggataaaaaggaagtgattaataataatataaagtttaggatatttaagggggatataaatatgtattggagatttattagagtatataaaatatatgtatgtttttaaaggatagttttatatttttttttttgtttaaattttatttattttattttttggtttggtgtaaatttttataaggtagtatgaagattaggtttagggaaagtatgtagggagttgtgggttttaagttgttatttttttgtggtaagtagggttttaaaataggtgggtttagtttggtgattgaaaattttgggattgtttggttgtttgtaattagttgttagtattagttttggttattttttattatttattggtgtttgaggggtaattattgtttgttggagagtgggagtttgtagtatttataattgttgaggattttttgattttagtttgttgtttttgttagattgttagtttagtgtgtagttggttgttggaaaatgattgtaatttttttgtattatatgtaagtttttttaatatgtttaatttttttgtatttttgttattattgttgttgttaatattgtttattattattatttatttaattttgtttttttttattttttttatgtgggtgttttttggtggaagtttatttatagttttgtgagggaagaggagtgggattatgggtttgaattttttttattttgtttttttagtttaaattttattttatttttttgttgttttatgtagtttgtgtgttgttgtgtgatttttggttttattttttgaatagatataaataaaatattaagtttttttttttttttattttttgaattaatttttaaaataaatgttttattttttaatttgaattaaagtggttttatttttttttagaggttaaggggtattagttttgaaaaggatttaaaaaggagaattttaaagggttgggttgttagtttttgttgtttagtttttagttattttttttttttattttttttttatggtagatttatttggagttttttgtgggagattttgtggtttgtgtttgaatttgaggttttaaggtatttttttttatgtttttttgtttgttattatgagattttgtttaatttgatttagttagtaaattttgaagttggattaatagaaatttgagtttttaatgtttttgtttattggtagaattattttgaggttaattttttaatttttttaagttttttttaataagattgtttgtttgtagaatgaagggattaatgtttattttataaggttattgttaggattaggtgagattgtttatttaagatgttaattagtgtttgggttttgtaggtaataaattattttaaaagatttaaagggtttgaaaggaggtgaaataatagaggtaaagagggagaaaagtgtttgttgggatattttagtgggatttatttagagttttaaatttatttgaaatttttatttaggttgttatttattttggggtttattttggtttttttgtgggggtattgttataattgttgtaaagtgtttagtatagtgttttgtatatagtaggtgttttatagatgttagttttttgttttttttatgttttttttttttatttgtgagttgtagaaatgtttttttgatttaaaatttaatgttttaagtttaggagttatttgtatatttttttgttttgtttttaaagagttgtgggttattaaattatggggttgaaatttggagtagagtgggtttgttttttgtgtagtgtgatattttttattgtataagttaatttgtggattttttttagttttttgggttttagttttttatttttgttttgtataatagttttagtgatttttttatttttttttttattgggtgttttttaataataaatgtttttatgttattatattatattgtgggttttgaaaatttaaaatatggttgatgtaatattaattgtttatagtggtataaaatatagggtaggagtttagttgggttgtagaggagataattgtgagtgttttgtgttgaagtgaagtgttttagaaggatgtgtttttgtgggttgtaaggttttttgtaggtaagaagagtttttgtatgtttgggttttggagagaattggaaatttgtttttattttttttttgaaaagttttttgttgttatttatttagttttttttttttttttaattgataattgtaaaagtttgggagatttttatggagaggatgagaggagttgttttttgagtgtaaggtttgttttaagatggtttagtagtattaggtttagtttttgagttatgtttttgagtttagttttttttaggtgtttgagatggtgatgtgtaggagtatttttattagtttttatgtgtaggttggagttgtagtttggttagtgaagtgttttattttttttttttttttgagtgtgttggaatggtgttgttgttttattttttggtttgttttaggaagtaattggagatgtggtttttttaggattgtgtagttgtttttgttatttgtttggtggaggtatagattttttgggggaggggaggtggtattagtaggtttggggtttatataaggttagtatgtatttgaattgtgtgattttggataagttatattgtttttttaagtttttgttgttagttgtaaaatttttttaaatttattttgaagagtaattgagggtgttttttaagattatttggagtaggtttttatttttttaattttgttagtttgtaatatgtatggtttaagatttagttgagagtttttttaatttgtattaagagaaagtgaagttagtatttgggggtgtttgtatggaaatttgtattgggtttttggagggtgggattttgagaattatttggttggaataggggttttatttagaatgagttaggtatatatattttagtatgattaaagttttggtaggtagaatttggtggtaggagttttgggtttttgaatggtgttatttttggttagtgattttttttttgtgtgtttaagtagttttagttttgtttattattttatgtttagtattttgtttaaggtttggtttagagtggtagatattagatgtttgttgaatgaatgaattaggtttttgttttgtaaaatgaaagtattttttttagttgaattttttttggatttaagggattgtagggaggaatagagttattagggataggtaagtttttttgggaatggggattggggtaaggtggtggtttgtattataggtttttatttaaggtagttagtgttttttttgtttaaatagaagagattgtgttttattttttggtggttatgggtatataggggatgttttgtgatatggtttttggaatttagaggaagagttagggaggggggattagggagtgattgttgttttgtttagtgtgtttgatgtttgagttttagtttttttattgtttttttgagatggaaatagttttggttttggaatggatatatttggggtggaataattgttttattttttatttaagtgattttattgttttgatttttagtgtttttatttgtaaaattggaaaaattggaaaaaagatttttttaggattgttttgatgattaaatgagattatgtaaggttagggtttgatatatagtaggtattaatagatattttgttgttttaaaatattttttgtatttagaaaagtgaaggtattgttgtggggtaagtttagggtttggagttaagtggaattaatattttttttttgtgagttatagtttggttagggtagtagtgtttattagtttttggagtggttgttatgggtaagatggaagtttaaaagaaattgttttgtatattgtgtgttttagttatgtaaggaatgaagtattttttttttgggagtgtttggtgtgaatatatagtttttattgagaagtttggttttggttagtggttttaggagtttggaattttttttttggtggaattttgggtattatttagtttttttgaaggttttagattttgtgttgtttttttttttgaggaggggtggggtgttagagggtaaaggagaagtaagggttttggatttttttttttttttagtgaatattttttttttgttttgtttttattttttggttttggtgttagaatgtttgagttgaaggggtagaatgtttaaaagttgtgtttgtttatttatttatttatttatttatttttattttttaaattgaagaaggtagtgaggtttagagagtaggatggatttagttggttttttttatttaaaatagtttttttttaattatgttattatattgtttgttttattttttttttagtttttaagattgtttgatagtatttatttagtttatttttgtttttttgaatttaatgtagggttttgtatagaataagtgttttataaatgtttgttggataaatgattagtgatgatatttaaaatgtatggtgggatttttttatgtgaggtattgttttaagtgttttagtgtatttgtttgttaatttttaaataatattatgagtaggtataatttttaattttattttatagatgagaatatggaggtatggagagtttatgtaatttgtttaggataagttatgaatatagttatttagtggagagatttggtaaaaatttggtgtttttgttttttttgtttttaagtgagattatttttggttggggtggggaagtggattgtttgggagtgaaggaggagtaggtgagtttgatttggtattagattaggtagtgtgagtagaggaggtggtgggagttgagaatgtttgttgtttttgttgggttttggagtttttatgtttttgtgttttgtgtgttatttgtgttttttgttttgtttgtgtgtgtttgtttgtgtgttttttatttagttttttttagtttttttttagttttgtgggtgtgaaattttggtttttatgtgttggagtgagggggtttgtgtttttgggtgtgtgtagagttgtttttttttttttttttttttttgtagagtggtgggagtttttgtggtaattttgttttggtgggtagatggagttagtgaggattttggtggataaattagttttttttttgattgtttttttttgattaagttaggttttttttgtttttttgatggtgtttttgtattagtgtgatttttagggttttttggttgggttagggtttgtttgttttttttggtgtttttggataggggtttttttttggttgtgttttggtttgaggagttttttggattgtgggaggggtgattgttgggtttgtgtggtttagaattttttttatgtgttgtttatatttttttttgtaaattgttagatttttgtttttttttttagtttagttttgtgtagttttgtttgttattggaggtaaattgggatagaaattgtgtttgtttt

SEQ ID NO: 98 - DNA, 9498 bp, Artificial Sequence
  chemically treated genomic DNA (Homo sapiens)
agagtgagtgtagtttttgttttagtttgtttttagtggtaggtaaggttgtgtagggttgaattgagggagggggtagaaatttgatagtttataaagaaaggtataagtaatgtgtggggaggattttgagttgtgtggatttggtaattgttttttttgtggtttaggggattttttaggttgggatgtagttgaagggaagtttttatttggaggtgttgggaggagtgggtgaattttgatttagttggggagttttgggagttgtgttagtgtggaagtgttgttgggggaataggggaaatttgatttgattggaaaagagtgattgaaggggagattaatttgtttgttggggtttttgttggttttgtttgtttgttggggtggggttattgtgggggtttttgttgttttgtggaagagaggaaagaggggaaggtgattttgtgtgtgtttggggatgtgggtttttttgttttggtatatgggggttagagttttgtgtttgtgaggttggagggaagttaagaggggttgagtgagagatatgtgaatagatgtatatagataggatgggagatgtgagtggtgtgtgggatataaaggtgtggaggttttgaagtttggtgaggatagtgggtgtttttggtttttattattttttttgtttgtgttgtttaatttggtgttaaattggatttatttgttttttttttatttttaggtggtttgtttttttattttagttagaggtgattttatttgagaatggaagaagtaaaggtattgggtttttgttaggtttttttattaaatggttgtgtttatgatttgttttgggtaagttatataaattttttatgtttttatgtttttatttgtaaaatggaattaaaaattgtatttatttatggtgttgtttaggaattaataaatgaatgtgttaaagtgtttggaatagtattttgtataggggaattttgttatatgttttagatattattattagttatttatttagtaaatatttgtagagtgtttgttttgtgtgaggttttgtgttgagtttagggaggtaggggtgaattgggtaggtgttattaggtagttttaaagattaggaaagaaataaaatgggtggtgtgataatgtgattggagaagagttgttttaggtaaaaggagttagttaagtttgttttgttttttaggttttattgttttttttgatttaaaaaataaaaataaataaataaataaataaataaataaatatggtttttaggtgttttgtttttttggtttaaatattttggtgttggggttaaaaagtgggaatagggtggggaagggatgtttgttgggaaggaggaggagtttaagatttttgttttttttttgttttttggtgttttgtttttttttgggaggaggagtagtgtgaagtttggagtttttgaaaaggttgaatggtgtttgggattttgttagggaggaggttttgggtttttggagttgttgattggggttaagttttttagtgggagttatgtatttgtattaggtatttttagggagagaatattttgttttttgtgtagttgggatgtatagtgtgtaaagtggttttttttaagtttttgttttgtttgtgataattattttgagagttgataggtattgttattttgattagattgtggtttatagagggaaaatgttgattttatttgattttaagttttgaatttgttttataatagtgtttttatttttttgagtataaaaaatgttttaaagtaatgaaatatttattaatgtttattatgtgttaggttttggttttatgtgattttatttaattattagagtaattttgagagagttttttttttagtttttttagttttatagatgaggatattgagggttagagtagtaaggttatttaagtaagagatggagtagttattttattttaggtgtgtttattttagagttggagttgtttttattttaggaggatagtaaaagaattggaatttaaatgttaggtatattgggtagggtagtggttattttttggttttttttttttggttttttttttaggttttaagggttatgttatagagtattttttgtgtatttataattattaaagggtgaagtatagttttttttatttaaataagaaggatattggttattttgaatgaaagtttgtgatgtagattattgttttgttttgatttttatttttagggagatttgtttatttttgatggttttgtttttttttatagttttttgaatttagaggggatttggttggaaggggtgtttttattttataaaataaaaatttaatttatttatttaatagatatttagtgtttgttattttaggttagattttgagtagagtgttggatatgaagtagtgaataaaattgagattatttaggtatatagagaggaagttgttggttagagataatattgtttaggagtttaggatttttgttattaagttttgtttattagggttttagttatgttggaatgtgtatgtttagtttattttagatgaagtttttgttttagttaggtagtttttaaagttttattttttggaggtttgatgtaggtttttatgtaaatatttttaaatattgattttatttttttttggtataagttaaagaaatttttagttgagttttggattgtatgtgttgtaagttgatagaattaggaaaatgaaaatttgttttaggtgattttaggaaatatttttaattattttttaaaataaatttggggaagttttatagttggtagtagaggtttagagaggtgatatgatttgtttaaggttatatggtttggatgtatattagttttgtgtaaattttagatttgttagtattatttttttttttttgagaggtttgtgtttttgttagatgagtggtaaaggtgattatataattttggggaaattatatttttagttgttttttgaagtaagttgaagagtgaggtgatggtgttgttttggtgtatttaggaggagggaaagggtggagtgttttgttgattgggttgtagttttggtttgtatgtaggaattggtgaaaatatttttgtgtattattgttttaggtgtttgaagaagattaggtttagaggtatggtttggagattggatttagtgttattggattgttttggagtagattttgtgtttaggaggtagttttttttattttttttgtaaaagttttttaaatttttgtagttgttaattaaaagaaaaaaaaagattaaataaataatggtagagaattttttgaaaagaggatggaggtagatttttggttttttttagagtttgaatatgtgaaggttttttttatttgtaggaaattttgtagtttgtaaaagtgtgtttttttggagtgttttgttttggtgtgggatgtttatggttgttttttttgtagtttggttgggtttttgttttgtgttttatattattataggtaattaatattgtattagttgtattttaaatttttaaaatttataatataatgtaatggtataagggtatttattattaaaggatatttgatggagagggaggtggaggaattgttggggttgttgtgtaaggtgggggtaaagggttgaggtttagggagttgggggagatttgtaagttagtttatgtggtagggggtgttgtattgtgtggagggtaaatttattttgttttgaattttggttttgtggtttgatgatttgtaattttttgaggatgaagtagggaaatgtgtagatgatttttggatttggagtattaaattttaaattaggaaggtgtttttatagtttgtaaataaaaagagggagtgtaaagagaatagggagttggtgtttatggagtatttattatgtatagggtattatgttaggtgttttgtagtagttatagtagtatttttataaagaagttgaggtggattttagagtgaataataatttggatgagaattttagatgaatttggaattttgagtgggttttattagagtgttttagtgaatatttttttttttttttgtttttattattttatttttttttaagttttttgaattttttaaaataatttgttgtttataaaatttaagtattagttgatgttttaaataaataattttatttagttttgataataattttgtgaaataagtgttggtttttttattttgtagataagtaattttgttggagaaggtttagagaaattaagaaattagttttaggatggttttgttagtgagtagaggtattggaggtttgaatttttattagtttggttttaaagtttattagttaagttaaattgagtagagttttatgatggtaggtagggaagtatggaaggaagtgttttgaaattttaagtttagatataagttgtagggttttttatgaggagttttaagtgagtttgttatggaagaggagtggggagaagggatggttgggggttgggtagtagaaattgatagtttaattttttggggtttttttttttaaattttttttaaagttagtattttttagtttttgagaaaaaataaaattattttgatttgggttgaaaaataaagtatttattttagaagttaatttaaggggtaaagggaaaagaaaatttaatattttatttgtatttatttagagaatgaaattaaaggttatatagtaatatataaattatatgaaataatgaaaaaataaaataaaatttgggttagaggggtagggtgagaagggtttaggtttatggttttatttttttttttttataaaattataagtgaatttttattgaaagatatttatataaagggaatggaaagaagtagaattaaataaataatagtaatgaatgatgttaataataatagtaataataaaagtgtaaggaggttagatgtgttgaaaggatttgtatataatgtagagaagttatagttgttttttagtagttgattgtatgttgagttggtaatttggtaagagtagtgagttggggttagagagtttttaatggttatgaatattataaatttttgttttttagtaagtagtaattattttttaaatattagtaggtagtgaaagatggttagagttggtgttggtagttgattataaatagttaagtgattttagaatttttagttgttagattgggtttatttgttttggagttttatttattatgaaaaaatggtaatttggagtttgtaattttttgtatattttttttgaatttaatttttatgttattttatgagaatttatgttaaattaaaggataaggtgaatagaatttaggtaaggaagggagtataaggttattttttggaaatatatatgtattttatatattttaataaatttttagtgtatgtttgtgttttttttagatattttagattttgtgttattattgattattttttttttatttttttattttttgtttaattgtgtttagtaaagtggtatttttattttagttttgggtggttgggttaattgattgttttttgttttggggtttttgttttgaagttgtgtggtttttgtgtgagggtaaattttagtattatggatagtataagtatatttaggtttgtttttttgtaatatttttttagtgttaaaatttttttggtgggaatagaaaggaaagagagagaaggttggaggtaattaggtgggataaagggggaaagtttgtggttttggaggagagagtttaatttgtttaggaaatgttttggagtttttgataattattttttgaatttgggagggatgagtattaggtttttttggtttttgatgttgtgttttgttgtaattagtggatagttgaatattttatttgtttttgtttttgtttttggttgtagaattagatttttattatgttttttttaaggtttagttttttagtgatggttgtgatttttttagatgaaggatgtggttggatagtgaaataggttttgagtgaatgtttttttggtgttgtgatggatgtgtgtttgtgtttttgtttgttgttgttgaagagttttggtttgttgttttttttttggtaggtggttttggttttttttaattaggtttggagtattggtttgagagtgattatgttgttgtgtgagagagtgagagatttgaatttgtagatggtgttttggtttagtgagtttatgttggggattttgagattagttagagttgtgtttatgtttgtttgggttatttttagtttgatgtgttgttgtttgaagtgtttggtgaaggtttttagtttgtgtgggtttgattttatgttgttgaggtatgtaggtatggtgttatgaggggttatggtgtgtgggtgatttatgtttatggtttggtgtaggtggtttatggtgtttaggtggtgtggatggatttgtgtgggtattattgagtgttttggagtgtttaggttgtttatatttagtgtgggtgagatgtgttttagtaggttgtttttgaggttttggtgtatggtgtggtgagggtgtgaggtgagtgtagttgggtgggagatgggtatggtggatgaagtggatgtgtagggtatgttgtttatggtatggtaggtggtgttgggtttgaatggatggtttttgttgtgggagatgatatttattgttgttagagttttggtgtgtgttagtaggtttttattaaagtttttaaatatattattttgtagttgtaagtgagaaggtgtatagtatggttagtagggaatattgttaatataggattaaaatatatttttaagtaattgagatgtttttttttaaagtttaggttataaaaattaatatggaggtagtggttttgttggaatagatgtgtggattagagatatgaatgagagagagagtgtgttgggagagaatgtgggggagataaggagaggggtttagatagtggtgattgttttgggtgatatgaaaaaaatatgaagttagtgtttgttaaaaaatgtgttttagagtggtaattatgttttattatgtatttgtggggttgggagatagatttggtgtatggttttggagttagagtgtagattggagaatttgggtttttgtagtattgggtgtatgttgaaaggttgtttggagtttatggttattatttttgtgtttttggtagggtggtagtgggtgatatggaattaggtttgtttagtttgtttgttgttttttaagtgagtgttgtttagtgtttgtgttttttttgtttttttgtttgttgtttttttttttttttatttgtttttttatttattttataagtagtttgttaggaagggtttgggtgtgtgtaggtgtgtttatgtgttggggatttgtaggggtggtttgggaggtgaggagagatagtagttagtggtgtgtttttttgtgtttgtggtggttgttttttttatagtttttatatttgggtttggtttggttttttttagtttgttttgttttgttggttttaatttgttagatttttttgatttttttttttttgtggatttttttttttttatgttattttaaaagttttaatttttttgttttgttttagtttgaattgtttggataaaagggtagttttgggttgagttggggtaggaagttgattttattttaattttttttttttattatatatatatatatatatatatatatatatatatatatatattttgttggtttggttgttgttaaattgtttatttttagggtgtttttggttttatgtttaagttgtttattagagtttggttttgtggtgtagtgaggaggtgtttttaagtgtttagatgggttttggagagggtgaggggttgttagaatgaggtttaggtgatttttgttttattttttttaattgtgttttggggtagaggtaggggtagtaattgtttttttagtttggggtggttttttttttatgtttgttttttttttttttatttgagggatgtaatttggtttattttttttttaatttttttgtttaaggaagtttgtggagtattttttttagaatagtgattgtttaggatggttttttaggtttgggagttttttagtgtatttttgttgggtagttagagtttgtaagtttattttttgtgataatagttattgtttaagagtttttaatatgtgttagataatttagagtttgtttatgggatttttatatttattgtatggagtaggtgatgttattttgttttatagatgaggaaaataaggattagaggggttaatgattagtttatttatttatttatttagttatttatttattttataaatatttattgatggtttgttgttttttaggtgttttagttttttggtttttttttttaaagttttggaatttgagggtttttgaggttagtattgtttgtttttattttttttagtttttttttttttttattttttttttttttttttttttttgttttgttttagtaaatattgtgaataatggatggggaattttggattttgattatgttgtattttggtttggagagaaattttgtgtgtgtagttgtatttttttgttagggttattgtttttgttgagagagtgatttttggggtttagagattttattttgtttgttattgtgtagggtatgtgtgtgttgggttttttagaatttgaatgaggtggggtggtgtggtttaggggaatattttttagtttaagaggatgttttgatagatttgggtttttttttttttttggtgttttttagttgtttttttttttatttgagttagttttttttgttggtttttgttttgtgatggtgggaaaaagatttagtttaggtgtttagagttaagtgtaatttttttgttaaagttttttgagttttggttttggtggtttttaaatggaattgtattattgtttgtttttttggattttggtgaagatgtttagagttagggtaagaagaaaagtattgagttatgaaattggtgtttagtaaatttttttataatttggtgttatagtgtttaggttttggttttagatttaaaatgtgtttttgttttttgttggttgagattatgagatatttttaatttttttgtattgtggtgtttttatttgtaaaatgggggtgattatttattttttattgattgttgtgaggaatgtattgggataagtatatggtatagtgtttggtgtattgatattattgaatatatgtttttttttttttttttaatttaaagagaaagtatgtgagagtgggggtgggttaagttatttttttggaatttggtttgtttgtatgtgtata

SEQ ID NO: 99 - DNA, 12727 bp, Artificial Sequence
  chemically treated genomic DNA (Homo sapiens)
gggttttttttttgtttgttttgggtttgatgtggttgtattttgtgttattagaggagttttttttttatttaagtgtgtttttttgtttagttttttttgtagatttttgttgggttgagttttttttgtttttaagagttaggagtggtttttgttgggatggaatgatttgtttttggggttgttttatgagtggtttttgtgaatttggattagttttgatgtgtaaattttattgtttggtttttagtgaatagatatagatttttgttattttttatgattttatagtttatgggattgggtttggggtagtgttagaggtatgtatggaggtgtgattttaggtgagttttgtggaaaatttttggtttatttgtgagttatggatagaatatgtagatttaggttttggtgatataagttttgtattgttaaaattgtgtgattttgagggttgattggtttgagaattttggatggtgtttttggttatttttattttttattttaattttttgggttttggttagaatttatagtttgtgtttgaagagtgttttttgtttttggtattttatttttgtttagttttagggaaaaggggagagggtagttttttgtagttagaggaagagtatattttttttggttgttttattttttgaagtagggtggttagttgaaggaggatatatttttgaggggtttagaggttgtttaagtttttttttgttttttgaagattgtgtattgagttgggtgtagtttttgggaattgtttttatttagattgttggggggtgggggggtaggatgagggtagagttgagaggttgtttaaggtttgggagagagaaaagttttttttaggatttgattttggtttttagtaattgtgatagttaaaaatgggtgttttgttttgataatagatttttgtggattttttggtatttggtttattagtgtttgtgaattttgttttgggagatttattgaaatttggatgtttaagttgggaggtgtgtagtaattaggaggatgagagggttgggtttgggttaggaaagtggttttttaaaatagatgttagggggattgtagttttgagttatgagaaaaaagttaaaggtgagatgatatgtattgaattggggtaaatattggaagaggagataaaattgtgtgtttgagtattggggtgtggggagggggggataaaatttgtatttagtgtaaattaaaattttgggagtaggtgggggttgttgtgtgttttttatttttagtttttttattaaggattttgagtttttatgtatttttgttttttggtttttttttttttttttgtttggttggtgagaggtggttgttggtgttttagtagtagttagatgttaggtgaagtttggagtgtggagtgtggggaagggaggggaagggaggggaggggaaaggaggggtggggtggggagtgtgtgtgggtttggttagtgtggggtggtgggtgggttgagtttggggatggtgtgggaggggggagggaaggggggtagttgtgggtagggagttgggtttggttgttagtattaaagatggagaggtgttggggttttgtaggggagggggtttggtgttgatgtgggatgtggtggaggtgtagtagttggtggtgatttgttaattttgtagtagagaggagttgagggtgatgagagtgggtattgtgaattgttgggtgatgttgttgttgttgttgtgatatggagagtaatagttttttagtaatatttttttttgatataggtatatattttttgataggtatgtatatttattttatagtgtttggtttggttgtggtgagtgaggggttgggaagaggtgtattgtttagtgagtgttgtgtgttggggttttttggggttggagaggtttggggggtgtgtgtttgttttggttatttggttgttgggtttgtgttttttttatttggtgtgttttttttttgttgttgtagttgttgttgttattggttgggggttggttagaagggggagttttggttgttagtttgggtgtagttgtttttttagttttttttttttagggtatggttggggtgagaggtggggggtgtagtggtgtgtgggggttgagggtgtgagtagaggggttggggatttggaggttttgtattgttaggggttggtggagtaatagagtttgtgggtgtttttatgtatgtggattggtgtgtgggtgtaagataaggttgtggtttatttatttgtgtgtttatttgttggttggttgggaagttagaattggaggagttgatgagtagatttgggggtggaggggagtaggattgggattgtttatgttttgtttttttttgagaaaatgtggtgggtttttttttgattggatttgatttttattttttttttgtaggggagggagggaagttttagagggtttgtagtgttgtgggttttttttggtttttggtgggattggtggtgatattggagtttgttgtgtgtttttggttgtttttggtgggtgttggtttttgtatttgatgtgtttgggatgttttttttattttggtgtgtttgttgttagtttgtatagtgttttgtatatttttgtatgtgtttgaaatgtgtatggttttgttggtttgtggaattatttggatgtatggagtgttttgtattgatttgtttgttgtttttttgagatgtttgtattgtgtttgggttgggtgtgttggttgttggtgttgttggttagaggtttgggatttagttggttgtttttagggggttatggttttgggttggagagggagggtgggtagatttttttttgtttttttttttataatttgttgtggggtttttgtgttttttttttgttgtggggtgggtttgttttttttgttgtttttgttgtggagtttagtttgtttggattgttgttgtttttttttgttttttttgtttttttttgtttttagtttagtttttttttttttaggagtttagttttttgggaaaagttgtttttttaagtttgttgaagttgtttttaagttttggtgggggttgttgggaattgggggggtgtgagagtgtggttgatttttggagtttgggtgggttattgttggtttttttttgtgttgtttggttggatgttgtagttagtgttagttggattgtgggtgttgagtggtgggtgggggagatggttgtttgtgggtgtttagattttttttaggatttaaaaggtttgttttagggtgttaagtttttatttttttggttgtttttttttagtttttagaaattttgatgtttgtgggaaagtatgtggtggtttggtttggttgaatgtttattttaattttgatggtttttgtttttattttggggtgggtagtaaaaatgttttgattagttgttttgtgaattttttttgtgtgagtttggtggtttttgaattgatagagttttttttgggggtggaggtaagtaagtagtgtttgaagagtgagggagagattttgttgttttttgtttttagtgtatttattgtaatattggttgttgtaagatagatatggggagggttttgggtttgtgtggtttttttaatatttttgtaagtgaggtttggagtttaggagtttttttattgattttgaataggttttgggagaggtttttgttttttagttttgttttttttttgtattggttgtaatttatattataggtgttggtgttaatattatttttagtgtttttgagttatgtttagtattttttgttgtttttggttataggatttgtagattttttggagtttgtgggatatatgtggagtttatatatttagtttagtatgagtatttttggttgtaggggattatatttaattatggtttttttttatattttaatgatttatttttttttgttttttagatttttttgtttattgggtagttgtgggtaggagggtaggtatgatattttatgtaagtgtgtgtgtgtaaatatatatatatttttttttttttttttgagatggagttttgtttttgttgtttaggttggagtgtagtggtataattttggtttatggtaatttttgttttttggttttaagtgatttttttgttttagttttttgagtagttgggattataggtgggtgttattgtgtttggttaattttgtattttttgtagagatggggtttttttatgttggttaggttggttttgaatttttgattttaggtgatttgtttgtttgggttttttaaagtgttgggattagaggtgtgagttattgtgttttgttttatatattttttttgtttgtttttggttggtgtatatatatatagtttagattttatattatatatataataattttgaggtttttgtgggtagaaatgatttaagttagtgtgtgggttgtgtgtgtttttgttagtatttagggatggggataggttttgggtttgttagtgttttgtagttttgagaatagtagaaggttagaggttaaggttgatggtgagaggatagtttttgtggaggagagtttagtgtttatagatttttgtggttatggttataggtttttggtttttaatgagtttgattttgtttttggggtttttgtagtgaggtagagtttggaaaaattgtttaaagataaggtttgatatttagggggttggtgtgaagttgataaggaaggggttaaagttttgttaattttaagtaagtgtattttattataatgaatgttggttttgtttagggagtttttatttttagatatagagaaagttgaggatttataggattttattataatttttattttattttatttaatagatgttatagagtagtgaattaggtatttgttgtggtagaattttttttttatttttagtatttttggtttgaaaggtagatttgtagatttttaggaagttattttaattaaaatttttaagatttttttgttaagggtttggtaatagggaggagggggtatgttgtagtggttgaatttttatttttagggatattgatgaatttgttttttgtttttttattttttttgtttttttttttttttttttttttagttttttttattggtttaggaagtttatttagttttgttatgtagagtttagaaggaaagaaagttttatgtttgagttgaggggagtattatggatttgataaaaatgggtatgatttagttgtagaattttagttattttatggggttattgtgtaaggttaattagatgtggttggttgggattttgtgtgatgtggttattatggtggatagttaggagttttatgtttattggatggtgttggtttgtattagtaagatgtttgagatttttttttattgtaatagttaatattatattttggatttttttttgttaaagattttttagtagattttggagtatgtatatatagttatgttgtaagttaaggtggaggatttggatgatttgttgtatgtggttgagattttggagattgagtatttggaggaatagtgtttgaagatgttggagattatttaggttttagatgataatgatatggaggttattatggttgatggtggggttgaggaagaagaggattgtaaggtttggtattttaagaatatttttattttgaagtattttagtgaggagagtgggtatgttagtgtggttggatagagtttttttgggtttatggtggattagagttttttagtttttattttatttggttttttagttatgagttttattaaggttgtagtggatagtttgatgattataggatagttttttttgtagggaattttttagttatttgtagggtttgaggagttaattttggttgggggtgggtggtattttggggtggttgaggtgaagatggagatgatgtaggtggatgaggtgtttagttaggatagttttggggtagttgagtttagtattttaggagggatgggggataaggttgaggaaagaggtaaagaggggtttgggattttgatttgaagtagtgttattattagtgttagggagttatattatgggtgagaggagagtgttgagtaggtgttatttttagttgaggttggttaggtttttattggttgatttgagtatttagtatttttgtttgagaagtatttgggtatttattttgtgttgtttaattataaggttgatgttgtattgagtatgttgttttttgtgatttttggtttttatgtgtagtttgttttggttgtttttatggattttagtatttatggggggttgttgttttagggttttatttagagggagttgtttagtaagttgggggagttggttgtgggtatgaagttagagagttggattattggagagtagtgtagtgtgtgtggggttgagttttttgataatgaggttgtggagtagtataggtaggttttgttttagttttgtatttgatgtaggatttgaggtttttatattttttttttatattttggttgtttttaagttaggggtttggtttttttgttttggtaatttgtgaaaaaattagaatattttttttaaagttttggtggggaggggagtaggttttttaaagtgtagtgagggggtttaggatttttttaaaaagtattaggggatatttatgggtgtagttttttaataggtttttttttttgttttttgtttttgggtttttgtttgtttttttggttgtttggtttgtttttttttgtttggagtgattgataaaatggagagaaggagaaaaggagtgggatgagggttttttgggttttgtatttgattatgttattaggttttaggtttttgggtttttatgtagtggtttttgtgaagatagtttgtttttttttgtagtttgggagaatgggagggtttgggggttgtttaagttataagagtagttgtaggttttgaattttatttttggtgaaagttaatttttttgttttgtttttttttttattttttgattttgtatatgtatttagggggaattgatttaaatgtaaggggaaaggatgggtataagagttttggttttgtagtttgtgaagttttatttttattttatttttgtttatattgaattaaatgttgttttaggttagtattggtttttttttggtttttgtttttttttttatgaaataattatttattgagtttttatgatatgtttggtttagtattaagtattttttatgagttgtatttttattataatagttttttgagataggtaatgttttttttttttttttggatgtgaagttttgttttttttgtttaggttggagtgtaatggtgtgatttttgtttattgtaatttttgtattttgggttaaggtgatttttttgttttagttttttgagtagtttggattataggtatgtattattatatttggttaattttgaatttttagtagagatgggtttttattgtgttggttaggatggttttgaatttttgattttaggtgattggtttgttttggttttttaaagtgttggattataggtatgagttattgtgtttagttggtaatgttttttttttatatggaataatattaaggtttagatgttaagttttttttttagggttatatagatagtaagaggtagagttggatttaaatttaggtttttattttttggtattttgttgttttttggagttatttagatttgaagaggattatgtttatggaatagagtgttttgaagattgtttataggaagtggagtaaataataggggggataagtagtgagtttgttttttttttttttgtttttgttataaattatgtgtttattattttattttttagtttttgggttagatgaatggagttaagaaatttagttttttgttgttattgatgatagtatttggttgtatattttgtggtttgttgttttgttgattttgggtggattttttattttttttttttttatttttatttttttgttgtttgtttaggtatgggggatgtgagtgagaggggttggggtggggatatttggaagttgattttattatttttagttggaatttgttttgattttgtttttttgatagtttagaggtttaatttgtggaaagtgtggtagagttaaatgtagttgattttttttagtgggtgtgaaaaataattgttattaaggtgtgtttttttgatgtttgtattgtttagaaatagattgaggttgtgtttgtttttgtttaaatttttttaaagaggaaatttgttttttaaagttgattagatagatgtattatttttttggatgtgaattattttggttgtgtgttatgagaattgggtatggtgggaagtaattgtttttttggtttttattaggttttggtttttggttgtttttttttatttgagagggttataaaagatattatttttttgagatttttaagtttttttttagtaagatttttatttttttggggagagagggagagttggttatgttatatttgaaagagtttgggtattggaattggttatatttagtggtgagagtttgtgatatttatttaatttttttgggttttgttttatttattatatttttttttttttttttttttgagatggagttttgttttgttattgggttggagtgtaatggtgtgattttagtttattgtagtttttattttttgggtttaagtgatttttttgttttagttttttgagtagttgggattataggtatttgttattttgtttagttaattttttgtatttttagtagagatagggttttattatgttggttagaatggttttgattttttgattttgtgatttatttattttggttttttaaagtgttgggattatagttgtgagttattttgtttggtttttatttattttttaaaatggagatggttaatagggttggtgttgaattaatgaagtaagatttagaaattattagagttgtgatgggtatatagttattgtagtggtggagaattgattatttgttttttgtgttgtttaggttttatttttgtatggtttttattggttttgagttttagtgtgtagtgtttatagtgttattttttatgagggttgtgttgattgtgaggtggtgtagagaatgtttttgtttttgtgagtatatgatagtaagatattggttttggaattttttgtgttatatgtgggttgttgataggaagaatgtgtttttgttgttgttgttgttgttgaggtagagttttattttgttgtttaggttgtagtgtagtggtatgattttggtttattgtaatttttattttttgggtttaagtgatttttttgttttagttttttgagtagttgggattatagatgtgtattattatgtttgattaatttttgtatttttagtagagatggggttttattatgttggttaggttggtttggaatttttggttttaagtgatttatttgttttggttttttatagtgttgggattataggtgtgtgttattttgttgggttgagaatgtgtttttgattgagggtggaaagttagtagttgtagtttaagaagttagagttaggggtagtgtttttgatgggaagtttgggggtttaaagaaattagaaaggggagaaaataattttgtgtgtgtttagtttttatttagattaatagttttttgggttttagttagatgtattttgtagaaggtttttttttttttttttatttttaaaattttaggattaatgtgttatttttttttttttattgttttttgtttttttttaatttattagtagtttgagaaatgttatggtggaaaaaaaaaaataatagttttataattagtataaataaaaagttaagataaaaaaaaaaaaaaaattagaaggggagattttgaggttaggaagttatggtatttattggaaatatattagtgataaaataataggttatagggtttattttattttatttttaagttaataggtttgagtgttggtaaagattagatatttagtagttttttttgtatttttttttggggtgggggggtagaagggaatggagaggaaatgaaggtggattgttggtaagtgaggtaggaaggtagggagtttattatggaatgttattggtaagtttttttatgatttgattttaagttggtgtggagtgaagggtaagttgttggtttaatagatagtgagaattaaatttagtggagttgtagagtttgttttttgtagtggatagtaagatgtataagttgtttattgtaggaatgatgtgttgtaaaagggatgtagtgttaagtgtagttatggatgggtgggaagattagataaaggtatttaatgggattgatttatttaaataaattagaaggaagttagaatagtgggaagatttgatagataagtagtattttgtaggtagatgaaggagtaagttttgggtttttaaatttttattagtgtatttatattatagaggataatgtttgagggaggggaagattattttaggattttggaatattgggtttttttttttttattttaaaaggttggagtagttttgtatgtaggtttttttggaaatggtttaggaattagtttatttaggttaggagtatttgattatttttagagttatgtatatatgtgataagattgtagggaatagtatagttttatagatttaagtgtgaatatagtttttatttatagtttttagttttttatggtttatgtagtttggtttttatgtgtttttgaatttagtgttgtagaggtataatggggtttggtttttggattttatatagataagtatttaggttagttgtagtggatgttttgtatagatattgttgtaatttttgtttggtttttttttgtttttggagatggagttttgttttgttttttaggttggagtgtagtggtgtgattttagtttattgtaagttttgttttttaggtttatgttatttttttgttttagttttttaagtagttgggattataggtatttgttattatgtttggttaattttttgtatttttagtagagatagggttttattgtgttagttagtatggttttgattttttgaatttgtgatttatttgttttggttttttaaagtgttgggattataggtgtgagttattatgtttggtttattgtttggtttttgaagggatttttaggaattatagggaatgtttgagttagttttttggatttgtgtgtatagttttttttagaggttttgtggagttagttgtatggtgtatgagttttgtggttaagatattagagttttgtttggtttttggttttggttttttttagatggttagttgttttgtttttagtggttgattatgtagaaggttaataggtgttgattttggtttaggttatttttgggatttttgaggttttttgagatttttggtttttttttattattttgtttagaatttttgatgttaaattaaattttgtttggaaaagggtatgttgtagaataatgatagttatagtaatgatattaataatattttttattggttgtagtatttttttttttgtaaagtatttttaatgattttattttttttgtttttatagttttttttgagtgggtataggtttataattttatatttgtgataatgaagtttgaaaagttttgaaaattaaaaagtttgtagtaaatttatttagtggtaaaatttgatttgaattgatgtgaggttatatttattttgtttagtttgaatatttatatgttttgttgtaaaaatattaatgtgtttgattatagagtgttgttttagattttgttggggttgttaaatatgataggtgttagagtatttttttttttttttttttttttttttttttgagatggagttttgttttgttgtttaggttggattgtggattgtagtggtgtaattttggtttattgtaagttttgttttttgggtttatgttatttttttgttttagttttttgagtagttgggattataggtgtttgttattgtgtttggttaattttttgtatttttagtagagatggggttttattttgttagttaggatggttttgattttttgattttatgatttatttgttttggttttttaaagtgttgggattataggtgtgagttattgtgtttggtttagagtatttttttaaagtttgaatagttttggttgttgaagtatttgaaggttttggataagggattatgaatgattattattttttattgataaatgaggaaaatgagatttggagtaagtaagtgattttttatggttatatagttataaatgggtagaattaggtatttagtttgttttttaatttatagttttgggtgttttgtattaggttatataagaatatgagtattgtttttttgggttaaatttatttgatttagtttttggttgttattattatgtttaagatattattattggaggttataattattttttttgatgt

SEQ ID NO: 100 - DNA, 12727 bp, Artificial Sequence
  chemically treated genomic DNA (Homo sapiens)
atgttaaggaagatggttgtagtttttaatggtggtattttaggtatggtgatggtaattaaagattaggttagatggatttgatttagaagagtaatgtttatgtttttatatggtttggtgtagagtgtttaggattgtgaattagaaggtaagttgagtgtttggttttatttatttatagttgtgtgattatgggaagttatttatttgttttaaattttattttttttatttgttaatagagaatgataattgtttataattttttatttaaaatttttaggtgttttaatgattaaaattgtttagattttagaaaggtattttgggttgggtgtggtggtttatgtttgtaattttagtattttgggaggttgaggtgggtggattatgaggttaggagattgagattattttggttaataaggtgaaattttgtttttattaaaaatataaaaaattagttgggtgtggtggtgggtgtttgtagttttagttatttgggaggttgaggtaggagaatggtgtgaatttgggaagtggagtttgtagtgagttgagattgtgttattgtagtttgtagtttgatttgggtgatagagtgagattttgttttaaaaaaaaaaaaaaaaaaaaaaaaagaaaggtattttgatatttattgtgtttaatagttttagtagagtttagggtagtattttgtaattaaatatattaatatttttgtagtaaaatatatgaatatttaaattaagtaggataaatatagttttatattagtttagattaggttttgttattaaatgagtttattgtaaattttttagtttttagagttttttagattttattattatagatatgggattatggatttgtatttatttaaggaaggttgtgagggtaagagagataaagttattagaggtgttttgtaaagaagaaaatgttgtaattgataaaaggtattattaatattattgttgtggttattattattttatagtatatttttttttaaatagaatttagtttgatattagaggttttggatgggatgatgaaagaaaattaagagttttaggaaattttaaaaattttaaaagtagtttaaattaaggttaatatttgttggttttttatatgattaattattaaaaatagagtagttgattatttgagagagattaaggttaagggttaggtagaattttgatattttagttataaagtttatgtattgtatagttggttttataaagtttttgggaagggttgtatatatggatttagaaagttggtttagatattttttgtggtttttgagaatttttttaagaattaggtaataggttgggtgtggtggtttatatttgtaattttagtattttgggaggttgaggtaggtggattatgagtttaggagattgagattatattggttaatatggtgaaattttgtttttattaaaaatataaaaaattagttgggtgtggtggtgggtgtttgtagttttaattatttgggaggttgaggtaggagaatagtgtgaatttgggaggtagagtttgtagtgagttgagattgtgttattgtattttagtttgggagatagagtgagattttatttttaaaaataaaaaggaattaggtaagagttgtgatggtgtttgtgtaggatatttattgtagttgatttaagtgtttgtttgtataagatttagaaattagattttattgtgtttttgtagtattaaatttagaaatatataaagattaagttgtgtgagttatgggagattagggattataaatgaggattatgtttatatttaagtttatagaattatattgttttttgtaattttattgtatatgtatgtaattttgagaatgattaggtgtttttggtttggatgagttggtttttagattatttttagagaagtttatatgtagaattgttttagttttttggaataagaaagggagggtttagtgttttagaattttgagatgattttttttttttttaggtattattttttgtaatgtggatgtattggtgaagatttgggggtttaaagtttgtttttttatttgtttgtagaatattgtttatttattagatttttttattgttttgatttttttttggtttgtttaggtaagttagttttattggatgtttttgtttggtttttttatttatttatgattatatttgatattgtattttttttatagtatgttatttttgtagtggatggtttgtatattttgttgtttgttgtaggaaataggttttataattttattaagtttgatttttattatttgttgagttaatagtttattttttattttatattagtttgggattaaattatggggaaatttattgatgatattttataataaattttttgtttttttgttttatttattagtaatttgtttttattttttttttatttttttttgtttttttattttaagaagaaatgtaagaaggattgttgggtatttagtttttattaatatttaggtttattgatttaaaaataaaataaaataaattttgtagtttgttattttattattgatatatttttagtgaatgttatggttttttggttttaaaatttttttttttgattttttttttttttttgttttggttttttgtttgtattggttatagggttgttgtttttttttttttattatagtattttttagattgttgatgggttggggggagatagagaatagtagaaaaaagggaatagtatattaattttggagttttgagggtgagggggagaaaaaaagttttttataaagtatatttagttgggatttgaggggttgttgatttgagtgagggttgagtatatgtaggattatttttttttttttttgatttttttagatttttaagttttttattaaaggtattgtttttggttttaattttttgggttgtagttgttgattttttatttttagttaaaagtatatttttggtttagtagggtggtatatatttataattttagtattatgggaggttgagataggtggattatttaaggttaggagttttaggttagtttgattaatatggtgaaattttatttttattaaaaatataaaaattagttgggtatggtggtatatatttgtagttttagttgtttaggaggttgaggtaggagaattatttgaatttgggaagtagaggttgtagtgagttaagattatgttattgtattgtagtttgggtgatagagtaagattttgttttaataataataataataataaaagtatattttttttgttagtagtttatatgtgatatggaggattttagggttagtgttttgttgttatatgtttataaggatagggatattttttgtattattttatagttaatataatttttatggagggtggtattgtggatattatatattagaatttagagttaatgaggattatgtagagatgaggtttaaataatataagggatagatggttagttttttattgttgtggtgattatgtgtttattatagttttagtgatttttggattttattttattaatttagtattaattttgttgattgtttttattttaagaagtgagtgaaggttgggtggggtggtttatagttgtaattttagtattttgggaggttgaggtggatggattgtaaggttaagagattgagattattttggttaatatggtgaaattttgtttttattaaaaatataaaaaattagttgggtggggtgataggtgtttgtagttttagttatttaggaggttgaggtaggagaattgtttgaatttgggaggtggagattgtagtgagttgagattatgttattgtattttagtttggtgatagagtgagattttgttttaaaaaaaaaaaaaaaaaaaaatgtagtgagtgaaataaggtttagaaaggttaaataagtattataggtttttattattaaatatggttaattttaatatttaggtttttttgaatataatatggttaattttttttttttttttagaggaatgagggttttgttgaaggggaatttggaagttttaggagagtggtattttttgtggtttttttgggtaaagaaaagtaattaggaattaggatttgatgagagttagaaaaataattattttttattatatttagtttttatagtatatagttgaaataatttatatttggaaagatgatatatttatttggttaattttggggagtgggttttttttttaggaaagtttgagtaaaaataaatataattttagtttatttttgagtggtataagtattaagaagatatattttagtggtggttattttttgtatttattggaaaaagttggttatgtttagttttgttatattttttataagttaagtttttgagttgttgaggaggtagggttagagtagattttggttaggggtgatgagattaatttttagatatttttattttaattttttttatttatattttttgtatttgaatgagtaataggggaatgggggtgaagggggaggaagtggagaatttatttaagattagtaaaatagtagattatagggtatgtagttaaatgttgttgttaatgataatagaaagttggattttttgattttatttatttgatttagaaattagaggataaaatgatgggtatgtggtttatgatagaagtaaggaaaaaaaaaataaatttgttatttattttttttgttatttattttattttttataagtaatttttaaaatgttttgttttatagatatgattttttttaagtttaagtgattttaagaggtagtaaagtattagggggtaaggatttaaatttgaatttagttttgttttttattatttatgtgattttagaaaagagatttgatatttgagttttagtattgttttatgtaaaagaaggatattattagttggatatggtggtttatatttgtaatttagtattttgggaggttgaagtaggttgattatttgaggttgggagtttgagattattttgattaatatggtgaaagtttgtttttattaaaaatttaaaattagttaggtatggtggtgtgtgtttgtaatttgagttatttgggaggttgaggtaggagaattattttaatttgggatgtagaggttgtggtgagtagagattatattattgtattttagtttgggtaaggagagtgaaattttatatttaaaaaaaaaagaaggatattatttattttaaagggttgttgtaatgaaaatgtaatttatggaaagtgtttagtattgaattaaatatgttataagagtttaatgaatggttattttatagagaaggaaatggaagttggagggaagttaatgttagtttgaagtggtatttagtttagtgtgagtagagatgggataagaatgagattttataggttgtaagattaagatttttatatttattttttttttttgtatttaaattaattttttttaaatgtatgtgtaggattagagaatgagaagggagatagagtaaggagattaatttttattaggaataaggtttagaatttgtagttgtttttgtggtttaagtagtttttagatttttttatttttttaagttgtagaaagggataggttgtttttatagggattattgtatgggaatttgaggatttgaaatttagtaatatggttagatgtagggtttaagagatttttattttattttttttttttttttttttattttattagttattttaagtaaaggagaatagattaaatagttgaaaaaataaataggggtttaaaagtaaaaaataaagggaagggtttattaagaagttgtgtttatgagtgttttttggtgttttttggaaagattttaggtttttttattatattttaaaaaatttgtttttttttttgttagaattttagaagaagtgttttggtttttttataaattgttaagataggggagttaggtttttaatttgggagtagttagggtgtgaaggaggggtgtgagggttttaagttttatattaggtgtggggttggagtggggtttatttgtgttgttttatagttttgttattaggaagtttgattttatatatgttgtattgttttttgatggtttggttttttgattttatgtttatagttagtttttttagtttgttgaatagttttttttggatgaagttttggggtagtagttttttataggtgttgaagtttatggagatagttagggtaggttgtatgtggaggttagaggttatggaagatggtatgtttaatatagtgttagttttgtggttgggtaatatggagtagatgtttagatgttttttaggtgggggtgttgggtgtttaggttggttagtgggggtttggttagttttagttgggggtggtatttgtttggtattttttttttgtttatagtgtagttttttagtattggtgatgatgttgttttgagttggggttttaggtttttttttgtttttttttttaattttgttttttattttttttgagatgttggatttggttgttttagggttgttttggttgggtattttatttatttgtattatttttgtttttattttagttattttagggtgttgtttatttttagttagagttggttttttgggttttgtaggtggttgaagagttttttgtaggagagattgttttatggttattaaattgtttattgtagttttggtgggatttatggttgaaagattaaatgaagtggagattgaagggttttggtttattatgggtttagggaggttttgtttagttatattggtatatttattttttttgttggaatgttttgagatgaagatgtttttgaggtattgagttttgtggttttttttttttttggttttgttattggttatggtggtttttgtgttattgttgtttgaggtttggatggtttttagtatttttaggtattgtttttttaggtatttgatttttaggattttggttgtatatagtaggttatttaggttttttgttttggtttgtagtgtggttgtatatgtatattttagaatttgttggaaggtttttggtgagaggaagtttaaagtatagtgttgattattgtggtggaagaggattttaaatattttgttggtgtaggttagtattgtttggtgggtgtggaatttttggttgtttattatgatgattatattgtataaagttttggttagttgtatttggttggttttgtatagtagttttgtggggtggttagggttttgtagttggattatgtttatttttgttagatttatggtgttttttttggtttaggtatgaggttttttttttttttgggttttgtgtggtggggttgggtgggttttttgggttaatagaggaggttaggagaaagaagaggggaagaagtaaaagagatgagagaataaaagataaatttattagtgtttttaaaagtaagaatttaattattataatatgtttttttttttttgttgttaagtttttagtaagaggattttagagattttaattgaagtagttttttagaaatttataaatttgttttttaagttagggatgttgagagtaaaaagaaggttttgttatagtagatgtttaatttattattttatgatatttgttagatgaagtgaaatgaaaattgtagtgaagttttataagtttttagttttttttgtgtttgagagtaggggttttttaggtaaggttaatatttattatgatgaagtgtatttatttaaaattagtaagattttagttttttttttgttagttttatgttagttttttggatgttaagttttatttttaaatagtttttttaaattttgttttattataggagttttagaagtagagttaaatttattggaggttaggagtttgtagttatggttatagaaatttatggatattgggtttttttttgtaaaggttatttttttattattagttttggtttttggttttttattgtttttagggttgtaaagtattggtagatttaaggtttgtttttatttttaggtattaataggaatatatataatttatatattaatttgggttatttttatttatggaagttttaaagttattgtatgtataatataaaatttgaattgtgtgtatgtatattagttagagatagatagaaagagtgtgtggggtagggtgtggtggtttatgtttttaattttagtattttgggaggtttaggtaggtggattatttgaggttgggagtttgagattagtttgattaatatggagaagttttgtttttataaaaaatataaaattagttaggtgtggtggtatttgtttgtaattttagttatttgggaggttgaggtaggagaattatttgaaattgggaggtggaggttgttgtgagttgagattgtgttattgtattttagtttgggtaataggagtaaaattttgttttagaaaaaaaaaaaaaagtgtgtgtgtgtttatatatatatatttatgtaaggtgttgtatttatttttttgtttataattgtttggtggataggaggatttaaaaaatgaagaaggatgggttattaaggtatggagagagattatagttaaatatggttttttatagttaggagtgtttatgttgggttgggtgtgtgaattttatgtgtgttttataggttttaaggagtttgtaagttttgtgattaggggtagtaagggatgttggatatggtttagaggtgttggaagtgatattggtattagtatttgtggtgtgagttataattagtatgaagggaagatagggttgggaaataaaggttttttttagagtttgtttgggattaataagagggtttttagattttaaattttgtttataggagtgttagaaagattgtgtaggtttaggattttttttgtgtttgttttatagtgattaatattgtagtgaatgtattgagagtaaggaatagtaaggttttttttttattttttgaatattgtttgtttgtttttatttttagaaggagttttattagtttaggagttattaagtttatgtagaaaggatttataggatggttggttaagatatttttgttgtttgttttggggtggggatggaggttgttaaggttgggatgagtatttagttgagttgagttattgtgtgtttttttgtagatattggggtttttgagaattaggagggaatagttaaaagaatggaagtttggtgttttgaaataagttttttgggttttgagggaaatttgggtgtttatgggtagttgttttttttatttgttgtttggtgtttgtgatttggttggtgttggttgtagtgtttagttaggtggtgtggggaagagttggtgataatttgtttgagttttggggattgattgtgtttttatatttttttagtttttagtgatttttattgagatttggagatgattttagtaaatttggggaagtaattttttttgaggagttagatttttgaaagaaggagagttgagttagggatgagggaaagtgaaagagatggggaggaatggtgatagtttgggtgggttggattttgtggtgagagtggtaggggaggtggatttgttttgtggtgaaggggaagtataaaagttttgtagtgagttgtgggaggaaaggtgagaaggggtttgtttgttttttttttttgatttagggttgtgattttttgggagtgattggttgggttttaggtttttggttagtggtgttagtggttagtgtgtttggtttaagtatggtgtgagtgttttggggaggtggtgagtgagttggtgtggagtgttttgtgtgtttgggtggttttgtgggttggtgggattgtgtgtattttaagtgtgtgtgggagtgtgtgaggtgttgtgtgagttagtggtgggtgtgttagggtgggaaaggtattttgaatgtattaggtgtagagattggtatttattgagagtggttgggagtgtatggtgagttttggtgttattgttggttttgttgagagttgaggagggtttgtagtgttgtagattttttggagttttttttttttttttgtaaaaggggggtggggattaagtttaattaagaaaaagtttattatgtttttttaaagagaaataaaatgtaagtagttttagttttgtttttttttgtttttagatttatttgttagtttttttgattttagttttttagttggttggtgaataaatatataaataaataaattataattttattttgtgtttgtgtattggtttgtatatataagagtatttatgggttttgttgttttgttagtttttggtggtataaagtttttggatttttgatttttttgtttatgtttttagtttttgtatattgttatgttttttattttttattttgattgtgttttgaagaggaagggttggggaggtagttgtgtttaggttgatagttggggtttttttttttagttgatttttaattggtggtggtgatggttgtagtggtaggaagggaatatgttaaataaaaaaggtataagtttagtggttgagtggttgaagtgagtgtgtgttttttagatttttttagttttgggaagttttggtgtgtggtgtttgttgggtggtgtgtttttttttggttttttatttattgtagttgagttgggtattgtggggtgggtgtgtgtgtttgttggggggtgtgtgtttgtgttggggaggggtgttgttggggaattgttgttttttgtattatggtggtagtgatagtattgtttggtagtttgtagtatttgtttttattgtttttaatttttttttgttgtgaggttagtaaattattattggttgttgtgtttttgttgtgttttatgttaatgttgagtttttttttttgtaaggttttggtgtttttttatttttagtgttggtggttgagtttggttttttgtttatagttgttttttttttttttttttttttgtgttgtttttgggtttagtttgtttattattttgtattggttgagtttgtgtgtgttttttgttttatttttttttttttttttttttttttttttttttttttttgtgttttgtgttttgggttttgtttgatatttagttgttgttggggtgttggtggttgttttttattggttgagtggagaggaaggaaggagttagaggataggagtgtatggggatttagaatttttaataggggaattgagggtgaagggtgtgtagtagtttttatttatttttaagattttaatttgtattggatatgggttttgtttttttttttttgtattttggtgtttaagtatgtagttttgtttttttttttaatgtttgttttaatttagtgtgtgttattttgtttttaattttttttttatggtttggggttgtagtttttttgatatttgttttaaaaggttgtttttttagtttaaatttggtttttttatttttttggttattgtgtgttttttggtttgagtatttggattttaataagttttttgaggtagagtttgtgggtgttagtgaattaggtgttagaaggtttgtggggatttattgttgaagtgagatatttgtttttagttgttgtgattgttggaggttaaggttgagttttgggagaaattttttttttttttaaattttggatagttttttggttttgtttttattttatttttttgttttttagtaatttgggtggaaatagtttttgagaattgtgtttagtttagtgtatagtttttagggggtagggggaagtttggataatttttgggttttttaaaagtgtgtttttttttagttggttgttttattttagagggtagagtagttaaagaaaatgtattttttttttgattgtagaaagttgttttttttttttttttttggagttgagtgaaggtagggtgttagaggtgggaagtgttttttgggtatgggttgtggattttgattgaagtttaggaggttggggtgggaggtgggggtggttgagagtgttatttagggtttttaggttagttagtttttgaggttatgtggttttagtaatgtggagtttatgttattaaggtttgagtttgtatgttttgtttgtgatttatgggtgggttagaggttttttgtaggatttatttagaattatatttttatgtgtgtttttggtattgttttagatttagttttatgaattgtagggttatggaaggtggtagaaatttgtatttgtttgttgaaggttaggtggtagagtttatatattggaattgatttgggtttataagagttgtttatgaggtagttttaaagatgggttattttattttagtaagagttatttttgatttttaagagtagggaaagtttagtttagtaggagtttgtggagagagttgggtaggggaatatatttgagtgaaggaagggtttttttgatagtatgggatataattatattaaatttagggtaagtggaggggaagttt

SEQ ID NO: 101 - DNA, 24 bp, Artificial Sequence
  APC_Primer forward
ttaatttttttgtttgttggggat

SEQ ID NO: 102 - DNA, 32 bp, Artificial Sequence
  APC_Primer reverse
cgtcgtcgaattacacaactacttctctctcc

SEQ ID NO: 103 - DNA, 152 bp, Artificial Sequence
  APC_Amplifikat
tcaacttccttgcttgctggggactggggccgcgagggcatacccccgaggggtacggggctagggctaggcaggctgtgcggttgggcggggccctgtgccccactgcggagtgcgggtcgggaagcggagagagaagcagctgtgtaatc

SEQ ID NO: 104 - DNA, 24 bp, Artificial Sequence
  CDO1_Primer forward
agagatttatttttaggtttttgg

SEQ ID NO: 105 - DNA, 30 bp, Artificial Sequence
  CDO1_Primer reverse
cgtcgtcgaccccacaaatctaaacctaat

SEQ ID NO: 106 - DNA, 91 bp, Artificial Sequence
  CDO1_Amplifikat
agagacccacccccaggcccctggcagcgcagtggatccgggatcgctggagacgcggtgcacacacaaatcaggttcagatctgtggggt

SEQ ID NO: 107 - DNA, 23 bp, Artificial Sequence
  CXCL12_Primer forward
ttttattggagagattgaggatt

SEQ ID NO: 108 - DNA, 33 bp, Artificial Sequence
  CXCL12_Primer reverse
cgtcgtcgttacttttcattaattctcattcaa

SEQ ID NO: 109 - DNA, 108 bp, Artificial Sequence
  CXCL12_Amplifikat
ccccactggagagactgaggaccttaggcgtaaagtggggcgcgcgtggaaagctgcgggacggggcctttcgatggcgggaactgaatgagaaccaatgaaaagcaa

SEQ ID NO: 110 - DNA, 22 bp, Artificial Sequence
  NCR1_Primer forward
tagagtagggtagggagtgtgg

SEQ ID NO: 111 - DNA, 34 bp, Artificial Sequence
  NCR1_Primer reverse
cgtcgtcgcacttcctatatatctatctccctaa

SEQ ID NO: 112 - DNA, 107 bp, Artificial Sequence
  NCR1_Amplifikat
cacttcctgtgtatctatctccctggcccgcccggctcagtccccactgctcagcactaggccggcagaatctgagcgatgtcttccacactccctgccctgctctg

SEQ ID NO: 113 - DNA, 22 bp, Artificial Sequence
  POU4F3_Primer forward
tagagtagggtagggagtgtgg

SEQ ID NO: 114 - DNA, 34 bp, Artificial Sequence; identical to SEQ ID NO: 111
  POU4F3_Primer reverse

SEQ ID NO: 115 - DNA, 107 bp, Artificial Sequence; identical to SEQ ID NO: 112
  POU4F3_Amplifikat

SEQ ID NO: 116 - DNA, 24 bp, Artificial Sequence
  ZBTB16_Primer forward
gagagagaaaagttttttttagga

SEQ ID NO: 117 - DNA, 31 bp, Artificial Sequence
  ZBTB16_Primer reverse
cgtcgtcgataaaccaaataccaaaaaatcc

SEQ ID NO: 118 - DNA, 115 bp, Artificial Sequence
  ZBTB16_Amplifikat
gagagagaaaagtttctcccaggactcgaccttggcctccagcaatcgcgacagctaaaaacgggtgtctcgcttcgacaatagatccccgcggaccttctggcacctggttcac

The invention claimed is:

1. A method for determining the methylation state of at least one CpG dinucleotide in the region of the CDO1 gene as set forth in SEQ ID NO: 13 in a subject, comprising:
   obtaining from the subject a biological sample comprising breast cancer cell genomic DNA;
   treating the breast cancer cell genomic DNA isolated from the biological sample with at least one bisulfite reagent, or series of bisulfite reagents, that distinguishes between methylated and non-methylated CpG dinucleotides; and
   determining the methylation state of at least one CpG dinucleotide in the region of the CDO1 gene as set forth in SEQ ID NO: 13 in the biological sample from the subject, and detecting if methylation is present.

2. The method of claim 1, wherein determining the methylation state comprises: contacting the treated genomic DNA, or a fragment thereof, with an amplification enzyme and at least one primer comprising a contiguous sequence of at least 9 nucleotides that is complementary to, or hybridizes under moderately stringent or stringent conditions to a sequence selected from the group consisting of SEQ ID NO: 45, 46, 85 and 86, and complements thereof, wherein the treated genomic DNA or the fragment thereof is either amplified to produce at least one amplificate, or is not amplified; and determining, based on a presence, absence or amount of the amplificate, the methylation state or methylation level of at least one CpG dinucleotide of SEQ ID NO: 13, or an average, or a value reflecting an average methylation state or methylation level of a plurality of CpG dinucleotides of SEQ ID NO: 13.

3. The method of claim 1, wherein the bisulfite reagent, or series of bisulfite reagents, is selected from the group comprising of bisulfite, hydrogen sulfite, disulfite, and combinations thereof.

4. The method of claim 1, wherein the biological sample obtained from the subject is selected from the group comprising cell lines, histological slides, paraffin embedded tissues, biopsies, tissue embedded in paraffin, bodily fluids and all possible combinations thereof.

5. The method of claim 4, wherein the bodily fluid is nipple aspirate or blood.

* * * * *